(12) United States Patent
Aponte et al.

(10) Patent No.: US 11,479,786 B2
(45) Date of Patent: Oct. 25, 2022

(54) PLANTS HAVING INCREASED TOLERANCE TO HERBICIDES

(71) Applicant: BASF SE, Ludwigshafen (DE)

(72) Inventors: Raphael Aponte, Durham, NC (US); Tobias Seiser, Ludwigshafen (DE); Stefan Tresch, Ludwigshafen (DE); Peter Alexander Bowerman, Durham, NC (US); Liliana Parra Rapado, Limburgerhof (DE); Matthias Witschel, Ludwigshafen (DE); Laetitia Souillart, Wuppertal (DE); Manuel Johannes, Hilden (DE); Thomas Mietzner, Annweiler (DE); Jill Marie Paulik, Durham, NC (US)

(73) Assignee: BASF SE, Ludwigshafen (DE)

( * ) Notice: Subject to any disclaimer, the term of this patent is extended or adjusted under 35 U.S.C. 154(b) by 0 days.

(21) Appl. No.: 16/767,917

(22) PCT Filed: Nov. 28, 2018

(86) PCT No.: PCT/IB2018/059413
§ 371 (c)(1),
(2) Date: May 28, 2020

(87) PCT Pub. No.: WO2019/106568
PCT Pub. Date: Jun. 6, 2019

(65) Prior Publication Data
US 2021/0002662 A1 Jan. 7, 2021

Related U.S. Application Data

(60) Provisional application No. 62/592,037, filed on Nov. 29, 2017.

(51) Int. Cl.
*C12N 15/82* (2006.01)
*A01N 43/54* (2006.01)

(52) U.S. Cl.
CPC ......... *C12N 15/8274* (2013.01); *A01N 43/54* (2013.01); *C12Y 103/03004* (2013.01)

(58) Field of Classification Search
CPC .................................................. C12N 15/8274
See application file for complete search history.

(56) References Cited

U.S. PATENT DOCUMENTS

| | | |
|---|---|---|
| 4,940,935 A | 7/1990 | Riley |
| 5,169,770 A | 12/1992 | Chee et al. |
| 5,188,642 A | 2/1993 | Shah et al. |
| 5,268,463 A | 12/1993 | Jefferson |
| 5,276,268 A | 1/1994 | Strauch et al. |
| 5,322,783 A | 6/1994 | Tomes et al. |
| 5,349,127 A | 9/1994 | Dean et al. |
| 5,366,892 A | 11/1994 | Foncerrada et al. |
| 5,376,543 A | 12/1994 | Chee et al. |
| 5,380,831 A | 1/1995 | Adang et al. |
| 5,399,680 A | 3/1995 | Zhu et al. |
| 5,424,412 A | 6/1995 | Brown et al. |
| 5,436,391 A | 7/1995 | Fujimoto et al. |
| 5,466,785 A | 11/1995 | de Framond |
| 5,561,236 A | 10/1996 | Leemans et al. |
| 5,565,350 A | 10/1996 | Kmiec |
| 5,569,597 A | 10/1996 | Grimsley et al. |
| 5,593,874 A | 1/1997 | Brown et al. |
| 5,593,881 A | 1/1997 | Thompson et al. |
| 5,602,321 A | 2/1997 | John |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,659,026 A | 8/1997 | Baszczynski et al. |
| 5,705,628 A | 1/1998 | Hawkins |
| 5,723,756 A | 3/1998 | Peferoen et al. |
| 5,737,514 A | 4/1998 | Stiffler |
| 5,747,450 A | 5/1998 | Ohba et al. |
| 5,767,373 A | 6/1998 | Ward et al. |
| 5,773,702 A | 6/1998 | Penner et al. |
| 5,792,931 A | 8/1998 | Duvick et al. |
| 5,859,348 A | 1/1999 | Penner et al. |
| 5,898,071 A | 4/1999 | Hawkins |

(Continued)

FOREIGN PATENT DOCUMENTS

| | | |
|---|---|---|
| CN | 101232811 A | 7/2008 |
| CN | 101232813 A | 7/2008 |

(Continued)

OTHER PUBLICATIONS

"Method of the Year 2011", Nature Methods, vol. 9, Issue 1, Dec. 28, 2011.
Aldemita et al., "Agrobacterium tumefaciens-mediated transformation of *japonica* and *indica* rice varieties", Planta, vol. 199, Issue 4, Aug. 1996, pp. 612-617.
Allison et al., "The nucleotide sequence of the coding region of tobacco etch virus genomic RNA: Evidence for the synthesis of a single polyprotein", Virology, vol. 154, Issue 1, Oct. 15, 1986, pp. 9-20.
Altschul, et al., "Basic local Alignment Search Tool", Journal of Molecular Biology, vol. 215, Issue 3, Oct. 5, 1990, pp. 403-410.

(Continued)

*Primary Examiner* — Weihua Fan
(74) *Attorney, Agent, or Firm* — Marshall, Gerstein & Borun LLP

(57) ABSTRACT

The present invention refers to a method for controlling undesired vegetation at a plant cultivation site, the method comprising the steps of providing, at said site, a plant that comprises at least one nucleic acid comprising a nucleotide sequence encoding protoporphyrinogen oxidase (PPO) which is resistant or tolerant to a PPO-inhibiting herbicide by applying to said site an effective amount of said herbicide. The invention further refers to plants comprising wild-type or mutated PPO enzymes, and methods of obtaining such plants.

12 Claims, 15 Drawing Sheets

Figure 1:
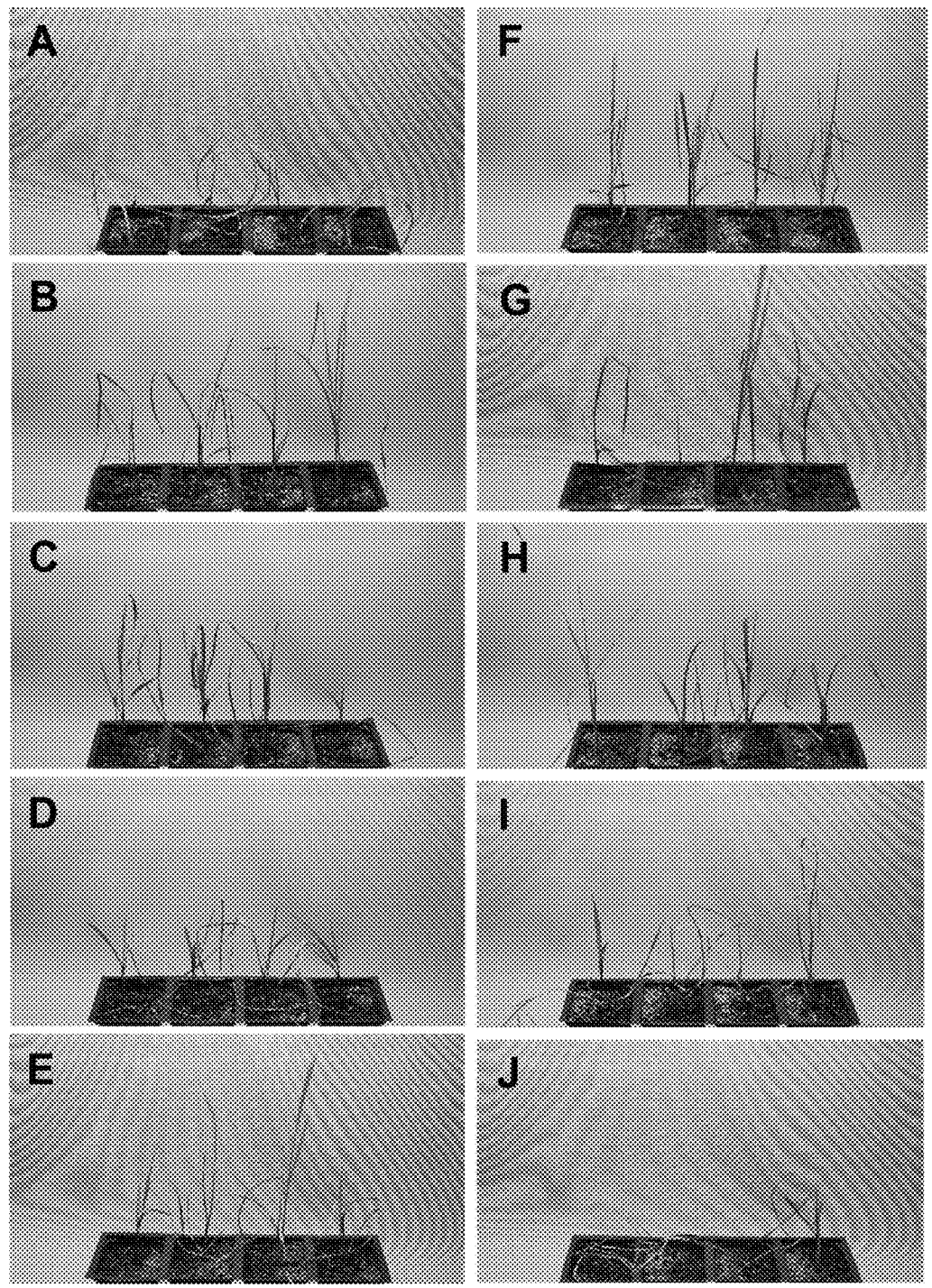

Specification includes a Sequence Listing.

(56) References Cited

U.S. PATENT DOCUMENTS

| | | | |
|---|---|---|---|
| 5,939,602 | A | 8/1999 | Volrath et al. |
| 5,952,544 | A | 9/1999 | Browse et al. |
| 5,981,722 | A | 11/1999 | Chen et al. |
| 5,990,387 | A | 11/1999 | Tomes et al. |
| 6,072,050 | A | 6/2000 | Bowen et al. |
| 6,121,512 | A | 9/2000 | Siminszky et al. |
| 6,177,611 | B1 | 1/2001 | Rice |
| 6,232,529 | B1 | 5/2001 | Singletary et al. |
| 6,300,544 | B1 | 10/2001 | Halkier et al. |
| 6,380,465 | B1 | 4/2002 | Barrett |
| 6,534,262 | B1 | 3/2003 | McKernan et al. |
| 6,649,814 | B2 | 11/2003 | Halkier et al. |
| 6,653,529 | B2 | 11/2003 | Peng et al. |
| 2005/0060767 | A1 | 3/2005 | Subramanian et al. |
| 2005/0246798 | A1 | 11/2005 | Castle et al. |
| 2007/0004912 | A1 | 1/2007 | Castle et al. |
| 2009/0011936 | A1 | 1/2009 | Hawkes et al. |
| 2009/0049567 | A1 | 2/2009 | Olhoft et al. |
| 2010/0100988 | A1 | 4/2010 | Tranel et al. |
| 2015/0252379 | A1* | 9/2015 | Hutzler ............. G01N 33/5097 800/300 |

FOREIGN PATENT DOCUMENTS

| | | |
|---|---|---|
| CN | 101325875 A | 12/2008 |
| CN | 106029890 A | 10/2016 |
| EP | 0242236 A1 | 10/1987 |
| EP | 0293356 A1 | 11/1988 |
| EP | 0337899 A1 | 10/1989 |
| EP | 0374753 A2 | 6/1990 |
| EP | 0427529 A1 | 5/1991 |
| EP | 0451878 A1 | 10/1991 |
| EP | 0397687 B1 | 5/1994 |
| EP | 0424047 B1 | 7/1995 |
| EP | 1198985 A1 | 4/2002 |
| TW | 201231656 A | 8/2012 |
| WO | WO-93/07256 A1 | 4/1993 |
| WO | WO93/07278 A1 | 4/1993 |
| WO | WO93/22443 A1 | 11/1993 |
| WO | WO94/11516 A1 | 5/1994 |
| WO | WO95/34656 A1 | 12/1995 |
| WO | WO99/43838 A1 | 9/1999 |
| WO | WO-00/15815 A1 | 3/2000 |
| WO | WO-02/15701 A2 | 2/2002 |
| WO | WO-02/068607 A2 | 9/2002 |
| WO | WO-03/018810 A2 | 3/2003 |
| WO | WO-03/052073 A2 | 6/2003 |
| WO | WO-2005/107437 A2 | 11/2005 |
| WO | WO-2006/024820 A1 | 3/2006 |
| WO | WO-2006/037945 A1 | 4/2006 |
| WO | WO-2006/136596 A2 | 12/2006 |
| WO | WO-2007/000077 A1 | 1/2007 |
| WO | WO-2007/024739 A2 | 3/2007 |
| WO | WO-2007/071900 A1 | 6/2007 |
| WO | WO-2007/096576 A1 | 8/2007 |
| WO | WO-2008/124495 A2 | 10/2008 |
| WO | WO-2008/141154 A2 | 11/2008 |
| WO | WO-2010/049269 A1 | 5/2010 |
| WO | WO-2010/049270 A1 | 5/2010 |
| WO | WO-2011/137088 A1 | 11/2011 |
| WO | WO-2012/080975 A1 | 6/2012 |
| WO | WO-2013/189984 A2 | 12/2013 |
| WO | WO-2015/022636 A2 | 2/2015 |
| WO | WO-2015/022640 A2 | 2/2015 |
| WO | WO-2015/092706 A1 | 6/2015 |

OTHER PUBLICATIONS

Archer et al., "Current views on chloroplast protein import and hypotheses on the origin of the transport mechanism", Journal of Bioenergetics and Biomembranes, vol. 22, Issue 6, Dec. 1990, pp. 789-810.

Arias, et al., "Molecular evolution of herbicide resistance to phytoene desaturase inhibitors in Hydrilla verticillata and its potential use to generate herbicideresistant crops", Pest Management Science, vol. 61, Issue 3, Jan. 2005, pp. 258-268.

Baim, et al., "A chimeric mammalian transactivator based on the lac repressor that is regulated by temperature and isopropyl beta-D-thiogalactopyranoside", Proceedings of the National Academy of Sciences of the United States of America, vol. 88, Issue 12, Jun. 15, 1991, pp. 5072-5076.

Bairoch, et al., "PROSITE: recent developments", Nucleic Acids Research, vol. 22, Issue 17, Sep. 1994, pp. 3583-3589.

Ballas et al., "Efficient functioning of plant promoters and poly(A) sites in Xenopus oocytes", Nucleic Acids Research, vol. 17, Issue 19, Oct. 11, 1989, pp. 7891-7903.

Bateman, et al., "The Pfam Protein Families Database", Nucleic Acids Research, vol. 30, Issue 1, Jan. 1, 2002, pp. 276-280.

Behrens, et al., "Dicamba Resistance: Enlarging and Preserving Biotechnology-Based Weed Management Strategies", Science, vol. 316, Issue 5828, May 25, 2007, pp. 1185-1188.

Bevan, "Binary Agrobacterium vectors for plant transformation", Nucleic Acids Research, vol. 12, Issue 22, Nov. 26, 1984, pp. 8711-8721.

Block, et al., "Transformation of *Brassica napus* and *Brassica oleracea* Using Agrobacterium tumefaciens and the Expression of the bar and neo Genes in the Transgenic Plants", Plant Physiology, vol. 91, Issue 2, Oct. 1989, 694-701.

Bock, "Transgenic Plastids in Basic Research and Plant Biotechnology", Journal of Molecular Biology, vol. 312, Issue 3, Sep. 21, 2001, pp. 425-438.

Brown et al., "Lac repressor can regulate expression from a hybrid SV40 early promoter containing a lac operator in animal cells", Cell, vol. 49, Issue 5, Jun. 5, 1987, pp. 603-612.

Buchman, et al., "Comparison of intron-dependent and intron-independent gene expression", Molecular and Cellular Biology, vol. 8, Issue 10, Oct. 1988, pp. 4395-4405.

Callis, et al., "Introns increase gene expression in cultured maize cells", Genes & Development, vol. 1, Issue 10, Dec. 1987, pp. 1183-1200.

Camp, et al., "Tissue-Specific Activity of Two Manganese Superoxide Dismutase Promoters in Transgenic Tobacco", Plant Physiology, vol. 112, Issue 2, Oct. 1996, pp. 525-535.

Campanella, et al., "MatGAT: An application that generates similarity/identity matrices using protein or DNA sequences", BMC Bioinformatics, vol. 4, Jul. 10, 2003, 4 pages.

Campbell et al., "Codon Usage in Higher Plants, Green Algae, and Cyanobacteria", Plant Physiology, vol. 92, Issue 1, Jan. 1990, pp. 1-11.

Canevascini, et al., "Tissue-Specific Expression and Promoter Analysis of the Tobacco ltp1 Gene", Plant Physiology 112.2 (1996): 513-524.

Castle, et al., "Discovery and Directed Evolution of a Glyphosate Tolerance Gene", Science, vol. 304, Issue 5674, May 21, 2004, pp. 1151-1154.

Chan et al., Agrobacterium-mediated production of transgenic rice plants expressing a chimeric alpha-amylase promoter/beta-glucuronidase gene, Plant Mol. Biol., 22(3):491-506 (Jun. 1993).

Chang et al., "Stable genetic transformation of *Arabidopsis thaliana* by Agrobacterium inoculation in planta", The Plant Journal, vol. 5, Issue 4, Apr. 1994, pp. 551-558.

Che, et al., "Localization of Target-Site of the Protoporphyrinogen Oxidase-lnhibiting Herbicide, S-23142, in *Spinacia oleracea* L.", Zeitschrift fur Naturforschung C, vol. 48, Issue 3-4, 1993, pp. 350-355.

Christensen et al., "Sequence analysis and transcriptional regulation by heat shock of polyubiquitin transcripts from maize", Plant Molecular Biology, vol. 12, Issue 6, Jun. 1989, pp. 619-632.

Christensen, et al., "Maize polyubiquitin genes: structure, thermal perturbation of expression and transcript splicing, and promoter activity following transfer to protoplasts by electroporation", Plant Molecular Biology, vol. 18, Issue 4, Feb. 1992, pp. 675-689.

Christopherson et al., "Ecdysteroid-dependent regulation of genes in mammalian cells by a *Drosophila* ecdysone receptor and chimeric transactivators", Proceedings of the National Academy of Sciences, vol. 89, Issue 14, 1992, pp. 6314-6318.

(56) References Cited

OTHER PUBLICATIONS

Clark et al., "Mutations at the transit peptide-mature protein junction separate two cleavage events during chloroplast import of the chlorophyll a/b-binding protein", The Journal of Biological Chemistry, vol. 264, 1989, pp. 17544-17550.
Clough et al., "Floral dip: a simplified method forAgrobacterium-mediated transformation of Arabidopsis thaliana", The Plant Journal, vol. 16, Issue 6, Dec. 1998, pp. 735-743.
Cole-Strauss, et al., "Targeted gene repair directed by the chimeric RNA/DNA oligonucleotide in a mammalian cell-free extract", Nucleic Acids Res., 27(5):323-30 (Mar. 1999).
Crossway, et al., "Integration of foreign DNA following microinjection of tobacco mesophyll protoplasts", Molecular and General Genetics MGG, vol. 202, Feb. 1986, pp. 179-185.
Dailey, et al., "Expression of a cloned protoporphyrinogen oxidase", The Journal of Biological Chemistry, vol. 269, Issue 2, Jan. 14, 1994, pp. 813-815.
Dayan, et al., "Biochemical and structural consequences of a glycine deletion in the a-8 helix of protoporphyrinogen oxidase", Biochimica et Biophysica Acta (BBA)—Proteins and Proteomics, vol. 1804, Issue 7, Jul. 2010, pp. 1548-1556.
Deblaere et al., "Efficient octopine Ti plasmid-derived vectors for Agrobacterium-mediated gene transfer to plants", Nucleic Acids Research, vol. 13, Issue 13, Jul. 11, 1985, pp. 4777-4788.
Degenkolb et al., "Structural requirements of tetracycline-Tet repressor interaction: determination of equilibrium binding constants for tetracycline analogs with the Tet repressor", Antimicrobial Agents and Chemotherapy, vol. 35, Issue 8, 1991, pp. 1591-1595.
Della-Cioppa et al., "Protein Trafficking in Plant Cells", Plant Physiology, vol. 84, Issue 4, Aug. 1987, pp. 965-968.
Deuschle et al., "Regulated expression of foreign genes in mammalian cells under the control of coliphage T3 RNA polymerase and lac repressor", Proceedings of the National Academy of Sciences, vol. 86, Issue 14, 1989, pp. 5400-5404.
Deuschle et al., "RNA polymerase II transcription blocked by Escherichia coli lac repressor", Science, vol. 248, Issue 4954, Apr. 27, 1990, pp. 480-483.
Dill et al., "Glyphosate-resistant crops: adoption, use and future considerations", Pest Management Science, vol. 64, Issue 4, Apr. 2008, pp. 326-331.
Duke, et al., "Protoporphyrinogen Oxidase-lnhibiting Herbicides", Weed Science, vol. 39, Issue 3, Jul. 1991.
Elroy-Stein et al., "Cap-independent translation of mRNA conferred by encephalomyocarditis virus 5' sequence improves the performance of the vaccinia virus/bacteriophage T7 hybrid expression system", Proceedings of the National Academy of Sciences, vol. 86, Issue 16, Aug. 1989, pp. 6126-6130.
Esvelt, et al., Genomescale engineering for systems and synthetic biology, Molecular Systems Biology, vol. 9, Issue 1, Jan. 1, 2013, 17 pages.
Falciatore, et al., Transformation of nonselectable reporter genes in marine diatoms, Marine Biotechnology, vol. 1, May 1999, pp. 239-251.
Feldmann et al., Agrobacterium-mediated transformation of germinating seeds of Arabidopsis thaliana: A non-tissue culture approach, Molecular Genetics and Genomics, vol. 208, Issue 1-2, 1987, pp. 1-9.
Figge et al., "Stringent regulation of stably integrated chloramphenicol acetyl transferase genes by E. coli lac repressor in monkey cells", Cell, vol. 52, Issue 5, Mar. 11, 1988, pp. 713-722.
Filho et al., "Mitochondrial and chloroplast targeting sequences in tandem modify protein import specificity in plant organelles", Plant Molecular Biology, vol. 30, Issue 4, Feb. 1996, pp. 769-780.
Frame et al., "Agrobacterium tumefaciens-Mediated Transformation of Maize Embryos Using a Standard Binary Vector System", Plant physiology, vol. 129, Issue 1, 2002, pp. 13-22.
Fuerst et al., "Transfer of the inducible lac repressor/operator system from Escherichia coli to a vaccinia virus expression vector", Proceedings of the National Academy of Sciences, vol. 86, Issue 8, pp. 2549-2553.
Gallie et al., "A comparison of eukaryotic viral 5'-leader sequences as enhancers of mRNA expression in vivo", Nucleic Acids Research, vol. 15, Issue 21, Nov. 11, 1987, pp. 8693-8711.
Gallie et al., "The Regulation of Gene Expression in Transformed Maize Aleurone and Endosperm Protoplasts (Analysis of Promoter Activity, Intron Enhancement, and mRNA Untranslated Regions on Expression)", Plant Physiology, vol. 106, Issue 3, Nov. 1994, pp. 929-939.
Gallie et al., "The tobacco etch viral 5? leader and poly(A) tail are functionally synergistic regulators of translation", Gene, vol. 165, Issue 2, 1995, pp. 233-238.
Gasteiger et al., "ExPASy: The proteomics server for in-depth protein knowledge and analysis", Nucleic Acids Research, vol. 31, Issue 13, 2003, pp. 3784-3788.
Geiser et al., "The hypervariable region in the genes coding for entomopathogenic crystal proteins of Bacillus thuringiensis: nucleotide sequence of the kurhd1 gene of subsp. kurstaki HD1", Gene, vol. 48, Isasue 1, 1986, pp. 109-118.
Gill et al., "Negative effect of the transcriptional activator GAL4", Nature, vol. 334, 1988, pp. 721-724.
Gossen et al., "Tight control of gene expression in mammalian cells by tetracycline-responsive promoters", Proceedings of the National Academy of Sciences, vol. 89, Issue 12, 1992, pp. 5547-5551.
Green, "Evolution of Glyphosate-Resistant Crop Technology", Weed Science, vol. 57, Issue 1, Feb. 2009, pp. 108-117.
Green, et al., "New multiple-herbicide crop resistance and formulation technology to augment the utility of glyphosate", Pest Management Science, vol. 64, Issue 4, Apr. 2008, pp. 332-339.
Guerineau, et al., "Effect of deletions in the cauliflower mosaic virus polyadenylation sequence on the choice of the polyadenylation sites in tobacco protoplasts", Molecular and General Genetics MGG, vol. 226, Issue 1-2, Apr. 1991, pp. 141-144.
Guevara-Garcia , et al., "Tissue?specific and wound?inducible pattern of expression of the mannopine synthase promoter is determined by the interaction between positive and negative cis? regulatory elements", The Plant Journal, vol. 4, Issue 3, Sep. 1993, pp. 495-505.
Hansen, et al., "Wound-inducible and organ-specific expression of ORF13 from Agrobacterium rhizogenes; 8196 T-DNA in transgenic tobacco plants", Molecular and General Genetics MGG, vol. 254, Issue 3, Apr. 1997, pp. 337-343.
Hiei, et al., "Efficient transformation of rice (Oryza sativa L.) mediated by Agrobacterium and sequence analysis of the boundaries of the T-DNA", The Plant Journal, vol. 6, Issue 2, Aug. 1994, pp. 271-282.
Hofgen, et al., "Storage of competent cells for Agrobacterium transformation", Nucleic Acids Research, vol. 16, Issue 20, Oct. 25, 1988, p. 9877.
Hu, et al., "The inducible lac operator-repressor system is functional in mammalian cells", Cell, vol. 48, Issue 4, Feb. 27, 1987, pp. 555-566.
Hulo, et al., "Recent improvements to the PROSITE database", Nucleic Acids Research, vol. 32, Issue suppl. 1, 2004, D134-D137.
Inui, et al., "Herbicide resistance in transgenic plants with mammalian P450 monooxygenase genes", Pest Management Science, vol. 61, Issue 3, Mar. 2005, pp. 286-291.
Ishida, et al., "High efficiency transformation of maize (Zea mays L.) mediated by Agrobacterium tumefaciens", Nature Biotechnology, vol. 14, Issue 6, pp. 745-750.
Jacobs, et al., "Assay for enzymatic protoporphyrinogen oxidation, a late step in heme synthesis", Enzyme, vol. 28, 1982, pp. 206-219.
Jobling, et al., "Enhanced translation of chimaeric messenger RNAs containing a plant viral untranslated leader sequence", Nature, vol. 325, 1987, pp. 622-625.
Jones, et al., Isolation of the tomato Cf-9 gene for resistance to Cladosporium fulvum by transposon tagging, Science, 266(5186):789-93 (Nov. 1994).
Joshi, "Putative polyadenylation signals in nuclear genes of higher plants: a compilation and analysis", Nucleic Acids Research, vol. 15, Issue 23, Dec. 10, 1987, pp. 9627-9640.
Kataoka, et al., "Isolation and Partial Characterization of Mutant Chlamydomanas reinhardtii Resistant to Herbicide S-23142", Journal of Pesticide Science, vol. 15, Issue 3, 1993, pp. 449-451.

(56) References Cited

OTHER PUBLICATIONS

Katavic, et al., "In planta transformation of *Arabidopsis thaliana*", Molecular and General Genetics MGG, vol. 245, Issue 3, May 1994, pp. 363-370.

Kawamata, et al., "Temporal and Spatial Pattern of Expression of the Pea Phenylalanine Ammonia-Lyase Genel Promoter in Transgenic Tobacco", Plant and Cell Physiology, vol. 38, Issue 7, Jan. 1, 1997, pp. 792-803.

Klaus, et al., "Generation of marker-free plastid transformants using a transiently cointegrated selection gene", Nature Biotechnology, vol. 22, 2004, pp. 225-229.

Klein, et al., "High-velocity microprojectiles for delivering nucleic acids into living cells", Nature, vol. 327, 1987, pp. 70-73.

Kleinschmidt, et al., "Dynamics of repressor-operator recognition: The Tn10-encoded tetracycline resistance control", Biochemistry, vol. 27, Issue 4,1988, pp. 1094-1104.

Koncz et al., "The promoter of TL-DNA gene 5 controls the tissue-specific expression of chimaeric genes carried by a novel type of Agrobacterium binary vector", Molecular and General Genetics MGG, vol. 204, Issue 3, Sep. 1986, pp. 383-396.

Krens, et al., "In vitro transformation of plant protoplasts with Ti-plasmid DNA", Nature, vol. 296,1982, pp. 72-74.

Labow, et al., "Conversion of the lac repressor into an allosterically regulated transcriptional activator for mammalian cells", Molecular and Cellular Biology, vol. 10, Issue 7, Jul. 1990, pp. 3343-3356.

Lam, "Analysis of Tissue-Specific Elements in the CaMV 35S Promoter", Plant Promoters and Transcription Factors, Results and Problems in Cell Differentiation book series, vol. 20, 1994, pp. 181-196.

Lamppa, "The chlorophyll a/b-binding protein inserts into the thylakoids independent of its cognate transit peptide", The Journal of Biological Chemistry, vol. 263, 1988, pp. 14996-14999.

Last, et al., "pEmu: an improved promoter for gene expression in cereal cells", Theoretical and Applied Genetics, vol. 81, Issue 5, May 1991, pp. 581-588.

Lawrence, et al., "Alterations in the Chlamydomonas Plastocyanin Transit Peptide Have Distinct Effects on in VitroImport and in Vivo Protein Accumulation", The Journal of Biological Chemistry, vol. 272, Issue 33, 1997, pp. 20357-20363.

Lee, et al., "Cellular Localization of Protoporphyrinogen-Oxidizing Activities of Etiolated Barley (*Hordeum; vulgare* L.) Leaves (Relationship to Mechanism of Action of Protoporphyrinogen Oxidase-lnhibiting; Herbicides)", Plant Physiology, vol. 102, 1993, pp. 881-889.

Letunic, et al., "Recent improvements to the SMART domain-based sequence annotition resource", Nucleic Acids Research, vol. 30, Issue 1, 2002, pp. 242-244.

Li, et al., "Development of PPO inhibitor-resistant cultures and crops", Pest Management Science, vol. 61, Issue 3, Mar. 2005, pp. 277-285.

Lommel, et al., "Identification of the Maize chlorotic mottle virus capsid protein cistron and characterization of its subgenomic messenger RNA", Virology, vol. 181, Issue 1, Mar. 1991, pp. 382-385.

Macejak, et al., "Internal initiation of translation mediated by the 5? leader of a cellular mRNA", Nature, vol. 353, 1991, pp. 90-94.

Maliga, "Progress towards commercialization of plastid transformation technology", Trends in Biotechnology, vol. 21, Issue 1, Jan. 2003, pp. 20-28.

Martin, et al.,"Map-based cloning of a protein kinase gene conferring disease resistance in tomato", Science, vol. 262, Issue 5138, 1993, pp. 1432-1436.

Matringe, et al., "p-Hydroxyphenylpyruvate dioxygenase inhibitor-resistant plants", Pest Management Science, vol. 61, Issue 3, Mar. 2005, pp. 269-276.

Matringe, et al., "Protoporphyrinogen oxidase as a molecular target for diphenyl ether herbicides", ?Biochemical Journal, vol. 260, Issue 1, 1989, pp. 231-325.

Matsuoka, et al.,"Tissue-specific light-regulated expression directed by the promoter of a C4 gene, maize pyruvate,orthophosphate dikinase, in a C3 plant, rice", Proceedings of the National Academy of Sciences, vol. 90, Issue 20, 1993, pp. 9586-9590.

McBride, et al., "Controlled expression of plastid transgenes in plants based on a nuclear DNA-encoded and plastid-targeted T7 RNA polymerase", Proceedings of the National Academy of Sciences, vol. 91 Issue 15, 1994, pp. 7301-7305.

McElroy, et al., "Isolation of an efficient actin promoter for use in rice transformation", The Plant Cell, vol. 2, Issue 2, Feb. 1990, pp. 163-171.

Mindrinos, et al., "The *A. thaliana* Disease Resistance Gene RPS2 Encodes a Protein Containing a Nucleotide-Binding Site and Leucine-Rich Repeats", Cell, vol. 78, issue 6, 1994, pp. 1089-1099.

Mlynarova, et al., "High efficiency Agrobacterium-mediated gene transfer to flax", Plant Cell Reports, vol. 13, Issue 5, Feb. 1994, pp. 282-285.

Mogen, et al., "Upstream sequences other than AAUAAA are required for efficient messenger RNA 3'-end formation in plants", The Plant Cell, vol. 2, Issue 12, Dec. 1990, pp. 1261-1272.

Moloney, et al., "High efficiency transformation of *Brassica napus* using Agrobacterium vectors", Plant Cell Reports, vol. 8, Issue 4, Apr. 1989, pp. 238-242.

Mulder, et al., "The InterPro Database, 2003 brings increased coverage and new features", Nucleic Acids Research, vol. 31, Issue 1, 2003, pp. 315-318.

Munroe, et al., "Tales of poly(A): a review", Gene, vol. 91, Issue 2, Jul. 16, 1990, pp. 151-158.

Murashige, et al., "A Revised Medium for Rapid Growth and Bio Assays with Tobacco Tissue Cultures", Physiologia Plantarum, vol. 15, Issue 3, Jul. 1962, pp. 473-497.

Murray, et al., "Codon usage in plant genes", Nucleic Acids Research, vol. 17, Issue 2, Jan. 25, 1989, pp. 477-498.

Nandihalli, et al., "Quantitative Structu re-Activity Relationships of Protoporphyrinogen Oxidase-Inh ibiting Diphenyl Ether Herbicides", Pesticide Biochemistry and Phasiology, vol. 43, Issue 3, 1992, pp. 193-211.

Needleman, et al., "A general method applicable to the search for similarities in the amino acid sequence of two proteins", Journal of Molecular Biology, vol. 48, issue 3, pp. 443-453.

Negrutiu, et al., "Hybrid genes in the analysis of transformation conditions", Plant Molecular Biology, vol. 8, Issue 5, Sep. 1987, pp. 363-373.

Odell, et al., "Identification of DNA sequences required for activity of the cauliflower mosaic virus 35S promoter", Nature, vol. 313, pp. 810-812.

Oliva, et al., "Evidence that tetracycline analogs whose primary target is not the bacterial ribosome cause lysis of *Escherichia coli*", Antimicrobial Agents and Chemotherapy, vol. 36, Issue 5, 1992, pp. 913-919.

Orozco, et al., "Localization of light-inducible and tissue-specific regions of the spinach ribulose bisphosphate carboxylase/oxygenase (rubisco) activase promoter in transgenic tobacco plants", Plant Molecular Biology, vol. 23, Issue 6, Dec. 1993, pp. 1129-1138.

Oshio, et al., "Isolation and Characterization of a Chlamydomonas reinhardtii Mutant Resistant to Photobleaching Herbicides", Zeitschrift fur Naturforschung, vol. 48C, Issue 3-4, 1993, pp. 339-344.

Padgette, et al., "Site-directed Mutagenesis of a Conserved Region of the; 5-Enolpyruvylshikimate-3-phosphate Synthase Active Site", Journal of Biological Chemistry, vol. 266, Issue 33, 1991, p. 22364-22369.

Potrykus, "Gene Transfer to Plants: Assessment of Published Approaches and Results", Annual Review of Plant Physiology and Plant Molecular Biology, vol. 42, 1991, pp. 205-225.

Proudfoot, "Poly (A) Signals", Cell, vol. 64, Issue 4, Feb. 1991, pp. 671-674.

Puchta, et al., "Gene targeting in plants: 25 years later", The International Journal of Developmental Biology, vol. 57, 2013, pp. 629-637.

Reines, et al., "Elongation factor SII-dependent transcription by RNA polymerase II through a sequence-specific DNA-binding protein", Proceedings of the National Academy of Sciences, vol. 90, Issue 5, 1993, pp. 1917-1921.

Reznikoff, "The lactose operon?controlling elements: a complex paradigm", vol. 6, Issue 17, Sep. 1992, pp. 2419-2422.

(56) References Cited

OTHER PUBLICATIONS

Rinehart, et al., "Tissue-Specific and Developmental Regulation of Cotton Gene FbL2A (Demonstration of Promoter Activity in Transgenic Plants)", Plant Physiology, vol. 112, Issue 3, Nov. 1996, pp. 1331-1341.

Romer, et al., "Expression of the Genes Encoding the Early Carotenoid Biosynthetic-Enzymes in Capsicum annuum", Biochemical and Biophysical Research Communications, vol. 196, Issue 3, Nov. 15, 1993, pp. 1414-1421.

Russell, et al., "Tissue-specific expression in transgenic maize of four endosperm promoters from maize and rice", Transgenic Research, Mar. 1997, vol. 6, Issue 2, pp. 157-168.

Sanfacon, et al., "A dissection of the cauliflower mosaic virus polyadenylation signal", Genes & Development, 1991, vol. 5, pp. 141-149.

Sasarmen, et al., "Nucleotide sequence of the hemG gene involved in the protoporphyrinogen oxidase activity of *Escherichia coli* K12", Canadian Journal of Microbiology, vol. 29, Issue 12, 1993, pp. 1155-1161.

Sato, et al., "Chapter 7—Characterization of a mutant of chlamydomonas reinhardtii resistant to protoporphyrinogen oxidase inhibitors", Porphyric Pesticides, vol. 559, Apr. 15, 1994, pp. 91-104.

Schenk, et al., "SeSaM: Sättigungsmutagenese eines Genes", Biospektrum, vol. 12, Mar. 2006, pp. 277-279.

Schmidt, et al., "A novel operon organization involving the genes for chorismate synthase (aromatic biosynthesis pathway) and ribosomal GTPase center proteins (L11, L1, L10, L12: rpIKAJL) in cyanobacterium Synechocystis PCC 6803", The Journal of Biological Chemistry, vol. 268, Issue 36, 1993, p. 27447-27457.

Schnell, et al., "Signal peptide analogs derived from two chloroplast precursors interact with the signal recognition system of the chloroplast envelope", The Journal of Biological Chemistry, vol. 266, Issue 5, 1991, pp. 3335-3342.

Schubert, et al., "Cloning of the Alcaligenes eutrophus genes for synthesis of poly-beta-hydroxybutyric acid (PHB) and synthesis of PHB in *Escherichia coli*", ?Journal of Bacteriology, vol. 170, Issue 12, 1988, pp. 5837-5847.

Schultz, et al., "SMART, a simple modular architecture research tool: Identification of signaling domains", Proceedings of the National Academy of Sciences USA, vol. 95, Issue 11, May 1998, pp. 5857-5864.

Shah, et al., "Engineering Herbicide Tolerance in Transgenic Plants", Science, vol. 233, Issue 4762, Jul. 25, 1986, pp. 478-481.

Shibata, et al., "Isolation And Characterization Of A Chlamydomonas Reinhardtii Mutant Resistant To An Experimental Herbicides-23142, Which Inhibits Chlorophyll Synthesis", Research in Photosynthesis, vol. III, ed. N. Murata, 1992, pp. 567-570.

Shillito, et al., "High Efficiency Direct Gene Transfer to Plants", Bio/Technology, vol. 3, 1985, pp. 1099-1103.

Siminszky, "Plant cytochrome P450-mediated herbicide metabolism", Phytochemistry Reviews, vol. 5, Issue 2-3, Jun. 2006, pp. 445-458.

Skuzeski et al., "Analysis of leaky viral translation termination codons in vivo by transient expression of improved B-glucuronidase vectors", Plant Molecular Biology, vol. 15, Issue 1, Jul. 1990, pp. 65-79.

Smith, et al., "Identification of Common Molecular Subsequences", Journal of Molecular Biology, vol. 147, Issue 1, Mar. 1981, pp. 195-197.

Staub, et al., "Accumulation of D1 polypeptide in tobacco plastids is regulated via the untranslated region of the psbA mRNA", The EMBO Journal, vol. 12, Issue 2, Feb. 1993, pp. 601-606.

Strepp, et al., "Plant nuclear gene knockout reveals a role in plastid division for the homolog of the bacterial; cell division protein FtsZ, an ancestral tubulin", Proceedings of the National Academy of Sciences, vol. 95,; Issue 8, 1998, pp. 4368-4373.

Svab, et al., "Stable transformation of plastids in higher plants", Proceedings of the National Academy of Sciences, vol. 87, Issue 21, 1990, pp. 8526-8530.

Svab, et al., "High-frequency plastid transformation in tobacco by selection for a chimeric aadA gene", Proceedings of the National Academy of Sciences, vol. 90, Issue 3, 1993, pp. 913-917.

Tan, et al., "Imidazolinone-tolerant crops: history, current status and future", Pest Management Science, vol. 61, Issue 3, Mar. 2005, pp. 246-257.

Terpe, et al., "Overview of tag protein fusions: from molecular and biochemical fundamentals to commercial systems", Applied Microbiology and Biotechnology, vol. 60, Issue 5, 2003, pp. 523-533.

Thomas, et al., "Site-directed mutagenesis by gene targeting in mouse embryo-derived stem cells", Cell, vol. 51, Issue 3, Nov. 6, 1987, pp. 503-512.

Van Damme, et al., "Molecular cloning of mannose-binding lectins from Clivia miniata", Plant Molecular Biology, vol. 24, Issue 5, 1994, pp. 825-830.

Velten, et al., "Isolation of a dual plant promoter fragment from the Ti plasmid of Agrobacterium tumefaciens", The EMBO Journal, vol. 3, Issue 12, Dec. 1984, pp. 2723-2730.

Von Heijne, et al., "CHLPEP—A database of chloroplast transit peptides", Plant Molecular Biology Reporter, vol. 9, Issue 2, May 1991, pp. 104-126.

Williams, et al., "Differences in zoospore germination and host penetration in response to temperature among Western Australian isolates of Plasmopara viticola", Australian Journal of Agricultural Research, vol. 58, Issue 7, pp. 702-710.

Wyborski, et al., "Analysis of inducers of the *E. coli* lac repressor system mammalian cells and whole animals", Nucleic Acids Research, vol. 19, Issue 17, Sep. 11, 1991, pp. 4647-4653.

Yamamoto, et al., "Light?responsive elements of the tobacco PSI?D gene are located both upstream and within the transcribed region", The Plant Journal, vol. 12, Issue 2, Aug. 1997, pp. 255-265.

Yamamoto, et al., "The Promoter of a Pine Photosynthetic Gene Allows Expression of a ?-Glucuronidase Reporter Gene in Transgenic Rice Plants in a Light-Independent but Tissue-Specific Manner", Plant and Cell Physiology, vol. 35, Issue 5, Jan. 1, 1994, pp. 773-778.

Yanase, et al., "Porphyrin synthesis involvement in diphenyl ether-like mode of action of TNPP-ethyl, a novel phenylpyrazole herbicide", Pesticide Biochemistry and Physiology, vol. 35, Issue 1, 1989, pp. 70-80.

Yao, et al., "*Drosophila* ultraspiracle modulates ecdysone receptor function via heterodimer formation", Cell, vol. 71, Issue 1, Oct. 1992, pp. 63-72.

Yarranton, 'Inducible vectors for expression in mammalian cells', Current Opinion in Biotechnology, vol. 3, Issue 5, Oct. 1992, pp. 506-511.

Zambretti, et al., "A mutant p53 protein is required for maintenance of the transformed phenotype in cells transformed with p53 plus ras cDNAs", Proceedings of the National Academy of Sciences, vol. 89, Issue 9, pp. 3952-3956.

Zhao, et al., "Immunological Characterization and Chloroplast Localization of the Tryptophan Biosynthetic Enzymes of the Flowering Plant *Arabidopsis thaliana*", The Journal of Biological Chemistry, vol. 270, Issue 11, pp. 6081-6087.

International Application No. PCT/IB2018/059413, International Search Report and Written Opinion, dated Mar. 19, 2019.

U.S. Appl. No. 16/303,783, filed Nov. 21, 2018, Tobias Seiser et al. Non-Final Office Action in U.S. Appl. No. 16/303,783 dated May 11, 2021.

\* cited by examiner

Figure 5 of 12
A)
1 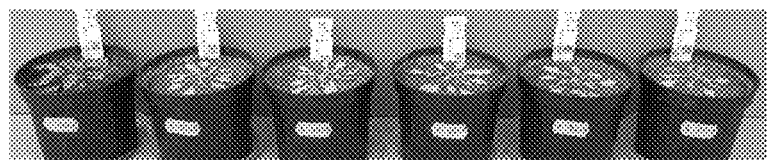
2 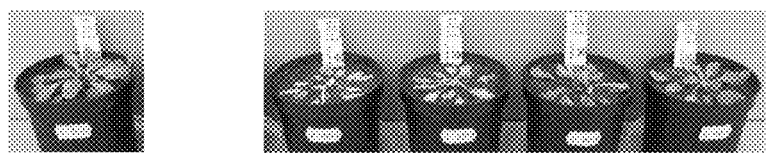
3 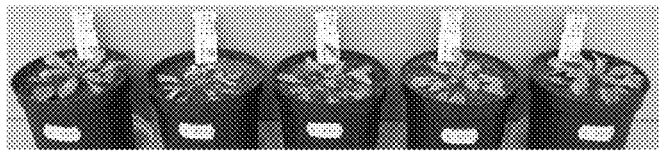
B)
1 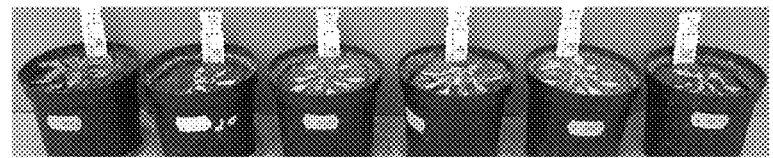
2 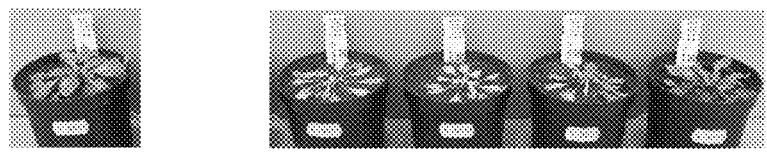
3 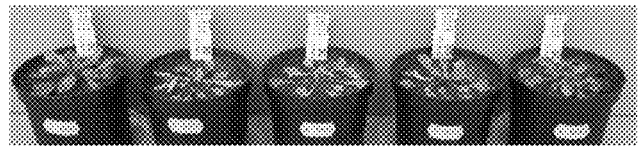

Figure 5 continued
C)
1
2
3
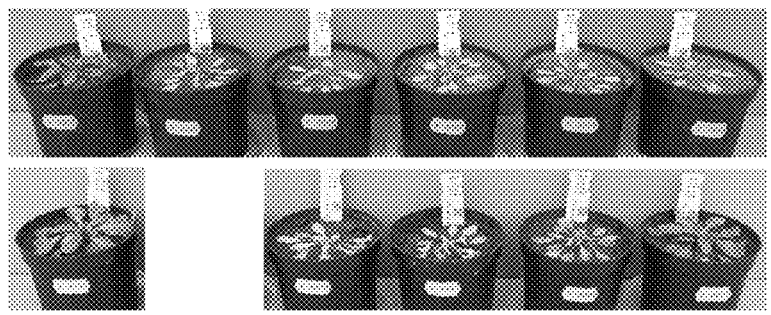
D)
1
2
3
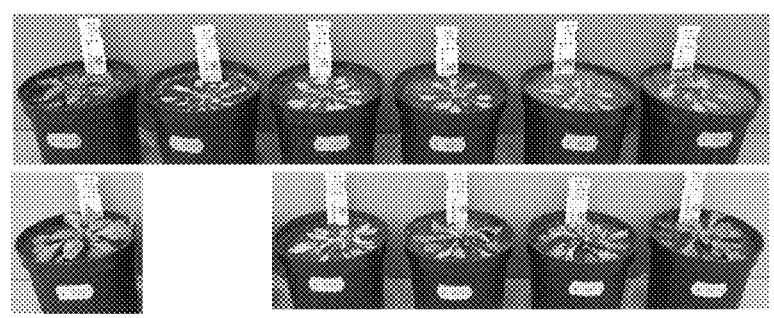

Figure 6:
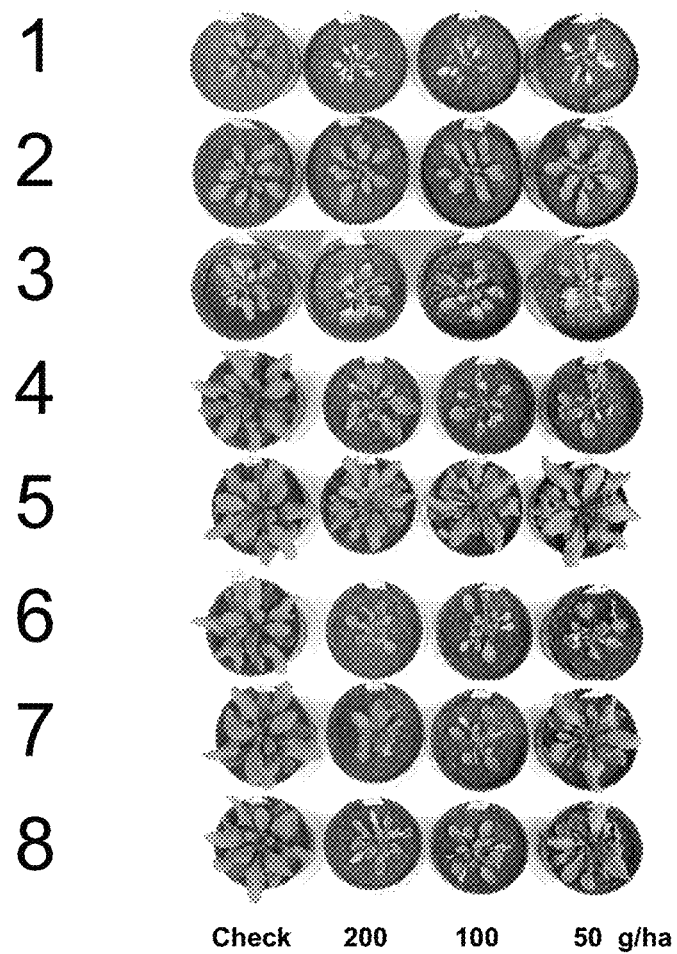
Figure 6:
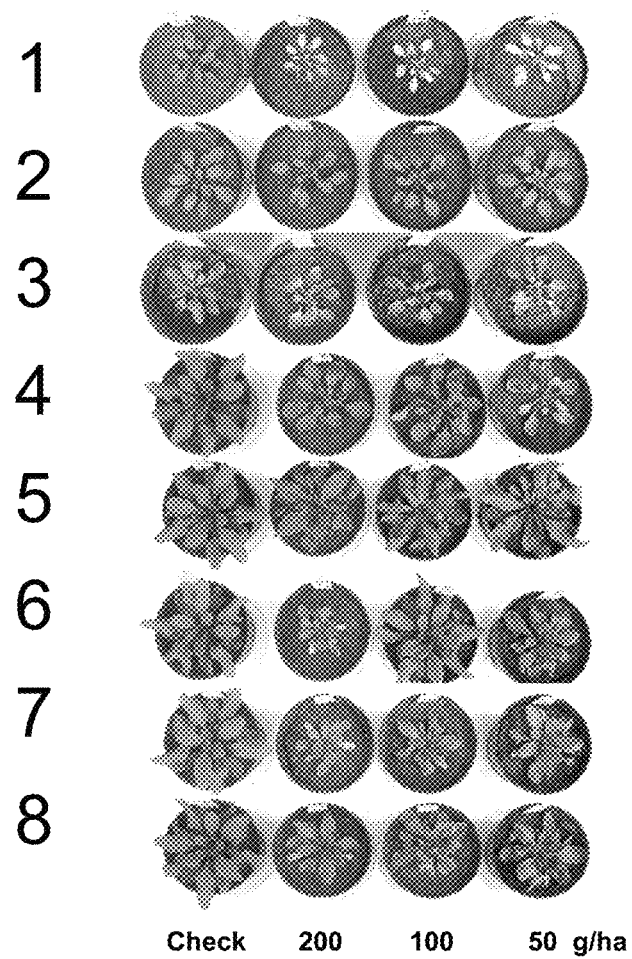

Figure 6 continued
C)
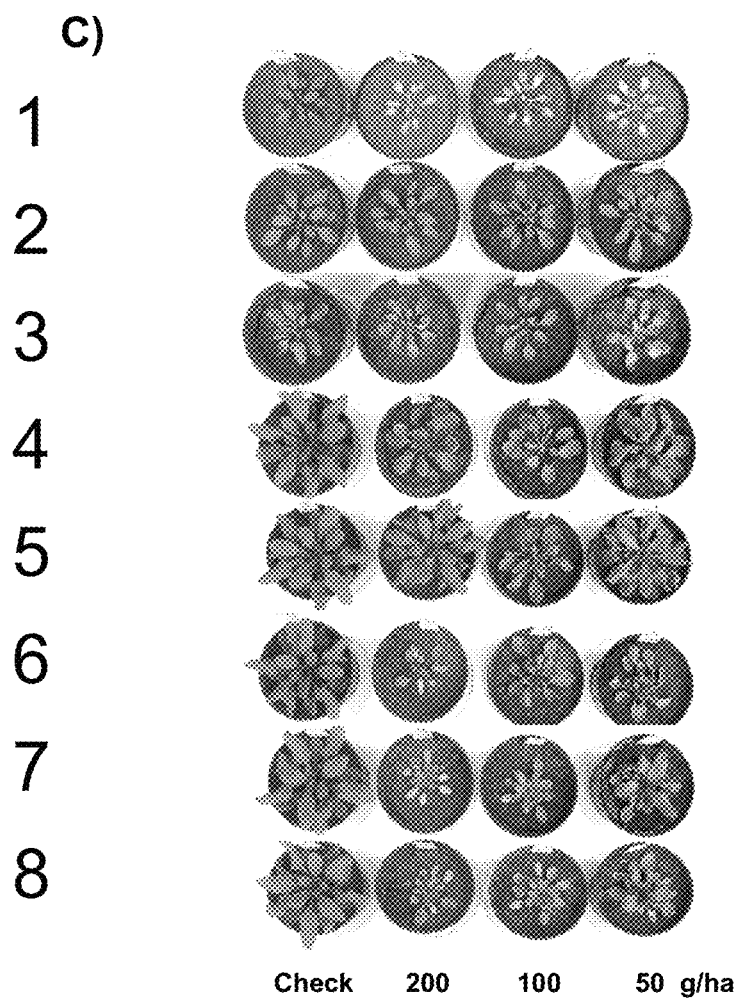
D)
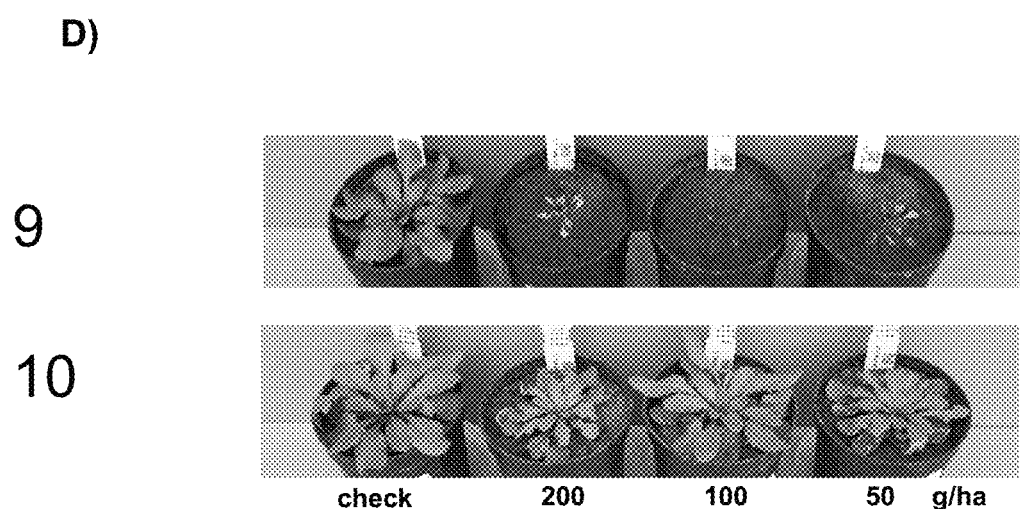

Figure 7 of 12
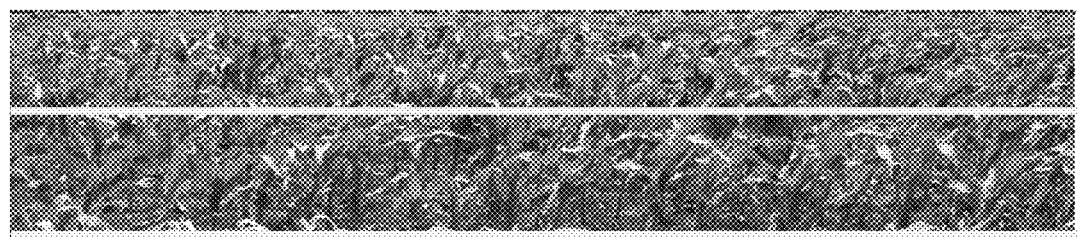
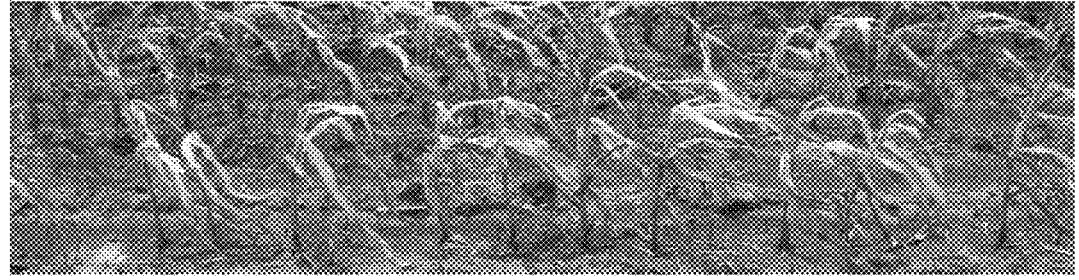

Figure 8 of 12
1 
2 
3 
4 
5 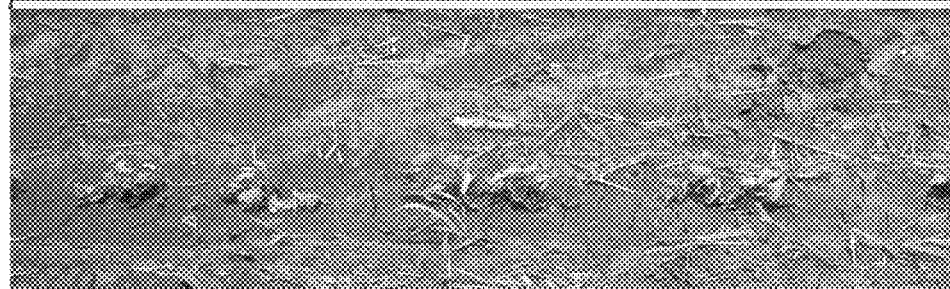

PLANTS HAVING INCREASED TOLERANCE TO HERBICIDES

This application is a National Stage application of International Application No. PCT/IB2018/059413, filed Nov. 28, 2018, which claims priority to U.S. Patent Application No. 62/592,037, filed on Nov. 29, 2017.

INCORPORATION BY REFERENCE OF MATERIAL SUBMITTED ELECTRONICALLY

The Sequence Listing, which is a part of the present disclosure, is submitted concurrently with the specification as a text file. The name of the text file containing the Sequence Listing is "1712288A_Seqlisting.txt", which was created on Apr. 27, 2020 and is 1,624,362 bytes in size. The subject matter of the Sequence Listing is incorporated herein in its entirety by reference.

FIELD OF THE INVENTION

The present invention relates in general to methods for conferring on plants agricultural level tolerance to herbicides. Particularly, the invention refers to plants having an increased tolerance to PPO-inhibiting herbicides. More specifically, the present invention relates to methods and plants obtained by mutagenesis and cross-breeding and transformation that have an increased tolerance to PPO-inhibiting herbicides.

BACKGROUND OF THE INVENTION

Herbicides that inhibit protoporphyrinogen oxidase (hereinafter referred to as Protox or PPO; EC:1.3.3.4), a key enzyme in the biosynthesis of protoporphyrin IX, have been used for selective weed control since the 1960s. PPO catalyzes the last common step in chlorophyll and heme biosynthesis which is the oxidation of protoporphyrinogen IX to protoporphyrin IX. (Matringe et al. 1989. Biochem. 1. 260: 231). PPO-inhibiting herbicides include many different structural classes of molecules (Duke et al. 1991. Weed Sci. 39: 465; Nandihalli et al. 1992. Pesticide Biochem. Physiol. 43: 193; Matringe et al. 1989. FEBS Lett. 245: 35; Yanase and Andoh. 1989. Pesticide Biochem. Physiol. 35: 70). These herbicidal compounds include the diphenylethers {e.g. lactofen, (+−)-2-ethoxy-1-methyl-2-oxoethyl 5-{2-chloro-4-(trifluoromethyl)phenoxy}-2-nitrobenzoate; acifluorfen, 5-{2-chloro-4-(trifluoromethyl)phenoxy}-2-nitrobenzoic acid; its methyl ester; or oxyfluorfen, 2-chloro-1-(3-ethoxy-4-nitrophenoxy)-4-(trifluorobenzene)}, oxidiazoles, (e.g. oxidiazon, 3-{2,4-dichloro-5-(1-methylethoxy)phenyl}-5-(1,1-dimethylethyl)-1,3,4-oxadiazol-2-(3H)-one), cyclic imides (e.g. S-23142, N-(4-chloro-2-fluoro-5-propargyloxyphenyl)-3,4,5,6-tetrahydrophthalimide; chlorophthalim, N-(4-chlorophenyl)-3,4,5,6-tetrahydrophthalimide), phenyl pyrazoles (e.g. TNPP-ethyl, ethyl 2-{1-(2,3,4-trichlorophenyl)-4-nitropyrazolyl-5-oxy}propionate; M&B 39279), pyridine derivatives (e.g. LS 82-556), and phenopylate and its O-phenylpyrrolidino- and piperidinocarbamate analogs. Many of these compounds competitively inhibit the normal reaction catalyzed by the enzyme, apparently acting as substrate analogs.

Application of PPO-inhibiting herbicides results in the accumulation of protoporphyrinogen IX in the chloroplast and mitochondria, which is believed to leak into the cytosol where it is oxidized by a peroxidase. When exposed to light, protoporphyrin IX causes formation of singlet oxygen in the cytosol and the formation of other reactive oxygen species, which can cause lipid peroxidation and membrane disruption leading to rapid cell death (Lee et al. 1993. Plant Physiol. 102: 881).

Not all PPO enzymes are sensitive to herbicides which inhibit plant PPO enzymes. Both the *Escherichia coli* and *Bacillus subtilis* PPO enzymes (Sasarmen et al. 1993. Can. J. Microbiol. 39: 1155; Dailey et al. 1994. J. Biol. Chem. 269: 813) are resistant to these herbicidal inhibitors. Mutants of the unicellular alga *Chlamydomonas reinhardtii* resistant to the phenylimide herbicide S-23142 have been reported (Kataoka et al. 1990. J. Pesticide Sci. 15: 449; Shibata et al. 1992. In Research in Photosynthesis, Vol. III, N. Murata, ed. Kluwer:Netherlands. pp. 567-70). At least one of these mutants appears to have an altered PPO activity that is resistant not only to the herbicidal inhibitor on which the mutant was selected, but also to other classes of protox inhibitors (Oshio et al. 1993. Z. Naturforsch. 48c: 339; Sato et al. 1994. In ACS Symposium on Porphyric Pesticides, S. Duke, ed. ACS Press: Washington, D.C.). A mutant tobacco cell line has also been reported that is resistant to the inhibitor S-21432 (Che et al. 1993. Z. Naturforsch. 48c: 350). Auxotrophic *E. coli* mutants have been used to confirm the herbicide resistance of cloned plant PPO-inhibiting herbicides.

Three main strategies are available for making plants tolerant to herbicides, i.e. (1) detoxifying the herbicide with an enzyme which transforms the herbicide, or its active metabolite, into non-toxic products, such as, for example, the enzymes for tolerance to bromoxynil or to basta (EP242236, EP337899); (2) mutating the target enzyme into a functional enzyme which is less sensitive to the herbicide, or to its active metabolite, such as, for example, the enzymes for tolerance to glyphosate (EP293356, Padgette S. R. et al., J. Biol. Chem., 266, 33, 1991); or (3) overexpressing the sensitive enzyme so as to produce quantities of the target enzyme in the plant which are sufficient in relation to the herbicide, in view of the kinetic constants of this enzyme, so as to have enough of the functional enzyme available despite the presence of its inhibitor. The third strategy was described for successfully obtaining plants which were tolerant to PPO inhibitors (see e.g. U.S. Pat. No. 5,767,373 or 5,939,602, and patent family members thereof.). In addition, US 2010/0100988 and WO 2007/024739 discloses nucleotide sequences encoding amino acid sequences having enzymatic activity such that the amino acid sequences are resistant to PPO inhibitor herbicidal chemicals, in particular 3-phenyluracil inhibitor specific PPO mutants.

WO 2012/080975 discloses plants the tolerance of which to a PPO-inhibiting herbicide named (1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione) had been increased by transforming said plants with nucleic acids encoding mutated PPO mutated enzymes. In particular, WO 2012/080975 discloses that the introduction of nucleic acids which code for a mutated PPO of an *Amaranthus* type II PPO in which the Arginine at position 128 had been replaced by a leucine, alanine, or valine, and the phenylalanine at position 420 had been replaced by a methionine, cysteine, isoleucine, leucine, or threonine, confers increased tolerance/resistance to a benzoxazinone-derivative herbicide. WO 2013/189984 discloses plants the tolerance of which to PPO inhibitors had been increased by transforming said plants with nucleic acids encoding mutated PPO enzymes, in which the Leucine corresponding to position 397 of an *Amaranthus* type II PPO had been replaced, and the phenylalanine corresponding to position 420 of an *Amaranthus* type II PPO had been replaced. WO2015/022636 discloses plants the tolerance of which to PPO inhibitors had been increased by transforming said plants with nucleic acids encoding mutated PPO enzymes, in which the Arginine corresponding to position 128 of an *Amaranthus* type II PPO had been replaced, and the phenylalanine corresponding to position 420 of an *Amaranthus* type II PPO had been replaced, but the replacement occurred with amino acids, which are different from those disclosed in WO 2012/080975. WO2015/092706 describes PPO polypeptides from a plurality of organisms, which PPO polypeptides had been mutated to comprise the advantageous mutations employed for the *Amaranthus* type II PPO. WO2015/022640 discloses PPO polypeptides from *Alopecurus myosuroides* and mutants thereof, which confer tolerance to a broad spectrum of PPO inhibiting herbicides.

The inventors of the present invention have now surprisingly found that those types of mutants confer increased tolerance/resistance to a new class of PPO inhibitors, hereinafter described as uracilpyridines or uracilpyridine herbicides. Thus, to date, the prior art has not described uracilpyridine tolerant plants containing a mutated PPO nucleic acid according to the present invention, which are tolerant/resistant to a broad selection of uracilpyridines.

Therefore, what is needed in the art are crop plants and crop plants having increased tolerance to uracilpyridines and containing at least one wildtype and/or mutated PPO nucleic acid according to the present invention. Also needed are methods for controlling weed growth in the vicinity of such crop plants or crop plants. These compositions and methods would allow for the use of spray over techniques when applying herbicides to areas containing crop plants or crop plants.

SUMMARY OF THE INVENTION

The problem is solved by the present invention which refers to a method for controlling undesired vegetation at a plant cultivation site, the method comprising the steps of:
a) providing, at said site, a plant that comprises at least one nucleic acid comprising a nucleotide sequence encoding a protoporphyrinogen oxidase (PPO) polypeptide which is resistant or tolerant to a "PPO inhibiting herbicide";
b) applying to said site an effective amount of said herbicide, wherein the PPO inhibiting herbicide is a uracilpyridine of formula (I)

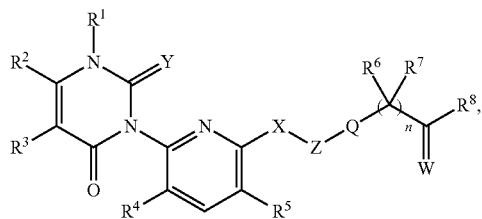

(I)

wherein the substituents have the following meanings:
$R^1$ hydrogen, $NH_2$, $C_1$-$C_6$-alkyl or $C_3$-$C_6$-alkynyl;
$R^2$ hydrogen, $C_1$-$C_6$-alkyl or $C_1$-$C_6$-haloalkyl;
$R^3$ hydrogen or $C_1$-$C_6$-alkyl;
$R^4$ H or halogen;
$R^5$ halogen, CN, $NO_2$, $NH_2$, $CF_3$ or $C(=S)NH_2$;

$R^6$ H, halogen, CN, $C_1$-$C_3$-alkyl, $C_1$-$C_3$-haloalkyl, $C_1$-$C_3$-alkoxy, $C_1$-$C_3$-haloalkoxy, $C_1$-$C_3$-alkylthio, $(C_1$-$C_3$-alkyl)amino, di($C_1$-$C_3$-alkyl)amino, $C_1$-$C_3$-alkoxy-$C_1$-$C_3$-alkyl, $C_1$-$C_3$-alkoxycarbonyl;
$R^7$ H, halogen, $C_1$-$C_3$-alkyl, $C_1$-$C_3$-alkoxy;
$R^8$ $OR^9$, $SR^9$, $NR^{10}R^{11}$, $NR^9OR^9$, $NR^9S(O)_2R^{10}$ or $NR^9S(O)_2NR^{10}R^{11}$, wherein
$R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_1$-$C_6$-haloalkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)aminocarbonyl-$C_1$-$C_6$-alkyl, di($C_1$-$C_6$-alkyl)aminocarbonyl-$C_1$-$C_6$-alkyl,
—N=$CR^{12}R^{13}$, wherein $R^{12}$ and $R^{13}$ independently of one another are H, $C_1$-$C_4$-alkyl or phenyl;
$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6 membered heteroaryl,
wherein each cycloalkyl, heterocyclyl, phenyl or heteroaryl ring can be substituted by one to four substituents selected from $R^{14}$ or a 3- to 7-membered carbocyclus,
which carbocyclus optionally has in addition to carbon atoms one or two ring members selected from the group consisting of —N($R^{12}$)—, —N=N—, —C(=O)—, —O— and —S—, and
which carbocyclus is optionally substituted with one to four substituents selected from $R^{14}$;
wherein $R^{14}$ is halogen, $NO_2$, CN, $C_1$-$C_4$-alkyl, $C_1$-$C_4$-haloalkyl, $C_1$-$C_4$-alkoxy or $C_1$-$C_4$-alkoxycarbonyl;
$R^{10}$, $R^{11}$ independently of one another are $R^9$, or together form a 3- to 7-membered carbocyclus,
which carbocyclus optionally has in addition to carbon atoms one or two ring members selected from the group consisting of —N($R^{12}$)—, —N=N—, —C(=O)—, —O— and —S—, and
which carbocyclus is optionally substituted with one to four substituents selected from $R^{14}$;
n 1 to 3;
Q $CH_2$, O, S, SO, $SO_2$, NH or ($C_1$-$C_3$-alkyl)N;
W O or S;
X NH, $NCH_3$, O or S;
Y O or S;
Z phenyl, pyridyl, pyridazinyl, pyrimidinyl or pyrazinyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy, $C_1$-$C_6$-haloalkoxy;

including their agriculturally acceptable salts or derivatives, provided the compounds of formula (I) have a carboxyl group and wherein the effective amount of said herbicide does not kill or inhibit the growth of the herbicide-tolerant plant of a).

In one embodiment, the herbicide resistant or tolerant PPO polypeptide comprises one or more of the following motifs 1, 2, and/or 3:
a. Motif 1: SQ[N/K/H]KRYI, wherein the Arg at position 5 within said motif is substituted by any other amino acid;
b. Motif 2: TLGTLFSS, wherein the Leu at position 2, and/or the Gly at position 3, and/or the Leu at position 5 within said motif is substituted by any other amino acid;
c. Motif 3: [F/Y]TTF[V/I]GG, wherein the Phe at position 4 within said motif is substituted by any other amino acid.

In another embodiment, the herbicide resistant or tolerant PPO polypeptide comprises a variant of the amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, which variant comprises one or more of the following substitutions:
a. the amino acid corresponding to Arg128 of SEQ ID NO: 1 is substituted by any other amino acid.
b. The amino acid corresponding to Gly211 of SEQ ID NO: 1 is substituted by any other amino acid
c. the amino acid corresponding to Leu397 of SEQ ID NO: 1 is substituted by any other amino acid.
d. the amino acid corresponding to Gly398 of SEQ ID NO: 1 is substituted by any other amino acid
e. the amino acid corresponding to Leu400 of SEQ ID NO: 1 is substituted by any other amino acid
f. the amino acid corresponding to Phe420 of SEQ ID NO: 1 is substituted by any other amino acid.

In still another embodiment, the herbicide resistant or tolerant PPO polypeptide comprises the amino acid sequence of SEQ ID NO: 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, or a variant thereof.

In still another embodiment, the herbicide resistant or tolerant PPO polypeptide comprises the amino acid sequence of SEQ ID NO: 240, 241, 242, 243, 244, 245, 246, 247, 248, 249, 250, 251, 252, 253, 254, 255, 256, 257, 258, 259, 260, 261, 262,or 264.

Another object refers to a method of identifying a nucleotide sequence encoding a mutated PPO which is resistant or tolerant to a uracilpyridine herbicide, the method comprising:
a) generating a library of mutated PPO-encoding nucleic acids,
b) screening a population of the resulting mutated PPO-encoding nucleic acids by expressing each of said nucleic acids in a cell or plant and treating said cell or plant with a uracilpyridine,
c) comparing the uracilpyridine herbicide-tolerance levels provided by said population of mutated PPO encoding nucleic acids with the uracilpyridine-tolerance level provided by a control PPO-encoding nucleic acid,
d) selecting at least one mutated PPO-encoding nucleic acid that provides a significantly increased level of tolerance to a uracilpyridine as compared to that provided by the control PPO-encoding nucleic acid.

In a preferred embodiment, the mutated PPO-encoding nucleic acid selected in step d) provides at least 2-fold as much tolerance to a uracilpyridine as compared to that provided by the control PPO-encoding nucleic acid.

The resistance or tolerance can be determined by generating a transgenic plant comprising a nucleic acid sequence of the library of step a) and comparing said transgenic plant with a control plant.

Another object refers to a method of identifying a plant or algae containing a nucleic acid encoding a mutated PPO which is resistant or tolerant to a uracilpyridine, the method comprising:
a) identifying an effective amount of a uracilpyridine in a culture of plant cells or green algae.
b) treating said plant cells or green algae with a mutagenizing agent,
c) contacting said mutagenized cells population with an effective amount of uracilpyridine herbicide, identified in a),
d) selecting at least one cell surviving these test conditions,
e) PCR-amplification and sequencing of PPO genes from cells selected in d) and comparing such sequences to wild-type PPO gene sequences, respectively.

In a preferred embodiment, the mutagenizing agent is ethylmethanesulfonate.

In another embodiment, the invention refers to a plant cell transformed by and expressing a wild-type or a mutated PPO nucleic acid according to the present invention or a plant which has been mutated to obtain a plant expressing, preferably over-expressing a wild-type or a mutated PPO nucleic acid according to the present invention, wherein expression of said nucleic acid in the plant cell results in increased resistance or tolerance to a uracilpyridine as compared to a wild type variety of the plant cell.

In another embodiment, the invention refers to a plant that expresses a mutagenized or recombinant mutated PPO polypeptide, and wherein said mutated PPO confers upon the plant increased uracilpyridine tolerance as compared to the corresponding wild-type variety of the plant when expressed therein.

In another embodiment, the invention refers to a plant comprising a plant cell according to the present invention, wherein expression of the nucleic acid in the plant results in the plant's increased resistance to uracilpyridine herbicide as compared to a wild type variety of the plant.

The plants of the present invention can be transgenic or non-transgenic.

Preferably, the expression of the nucleic acid of the invention in the plant results in the plant's increased resistance to uracilpyridine herbicides as compared to a wild type variety of the plant.

In another embodiment, the invention refers to a method for growing the plant according to the present invention while controlling weeds in the vicinity of said plant, said method comprising the steps of:

a) growing said plant; and
b) applying a herbicide composition comprising a uracilpyridine herbicide to the plant and weeds, wherein the herbicide normally inhibits protoporphyrinogen oxidase, at a level of the herbicide that would inhibit the growth of a corresponding wild-type plant.

In another embodiment, the invention refers to a seed produced by a transgenic plant comprising a plant cell of the present invention, or to a seed produced by the non-transgenic plant that expresses a mutagenized PPO polypeptide, wherein the seed is true breeding for an increased resistance to a uracilpyridine herbicide as compared to a wild type variety of the seed.

In another embodiment, the invention refers to a method of producing a transgenic plant cell with an increased resistance to a uracilpyridine herbicide as compared to a wild type variety of the plant cell comprising, transforming the plant cell with an expression cassette comprising a wild-type or a mutated PPO nucleic acid.

In another embodiment, the invention refers to a method of producing a transgenic plant comprising, (a) transforming a plant cell with an expression cassette comprising a wild-type or a mutated PPO nucleic acid, and (b) generating a plant with an increased resistance to uracilpyridine herbicide from the plant cell.

Preferably, the expression cassette further comprises a transcription initiation regulatory region and a translation initiation regulatory region that are functional in the plant.

In another embodiment, the invention relates to using the mutated PPO of the invention as selectable marker. The invention provides a method of identifying or selecting a transformed plant cell, plant tissue, plant or part thereof comprising a) providing a transformed plant cell, plant tissue, plant or part thereof, wherein said transformed plant cell, plant tissue, plant or part thereof comprises an isolated nucleic acid encoding a mutated PPO polypeptide of the invention as described hereinafter, wherein the polypeptide is used as a selection marker, and wherein said transformed plant cell, plant tissue, plant or part thereof may optionally comprise a further isolated nucleic acid of interest; b) contacting the transformed plant cell, plant tissue, plant or part thereof with at least one PPO-inhibiting inhibiting compound; c) determining whether the plant cell, plant tissue, plant or part thereof is affected by the inhibitor or inhibiting compound; and d) identifying or selecting the transformed plant cell, plant tissue, plant or part thereof.

The invention is also embodied in purified mutated PPO proteins that contain the mutations described herein, which are useful in molecular modeling studies to design further improvements to herbicide tolerance. Methods of protein purification are well known, and can be readily accomplished using commercially available products or specially designed methods, as set forth for example, in Protein Biotechnology, Walsh and Headon (Wiley, 1994).

In another embodiment, the invention relates to a combination useful for weed control, comprising (a) a polynucleotide encoding a mutated PPO polypeptide according to the present invention, which polynucleotide is capable of being expressed in a plant to thereby provide to that plant tolerance to a uracilpyridine herbicide; and (b) a uracilpyridine herbicide.

In another embodiment, the invention relates to a process for preparing a combination useful for weed control comprising (a) providing a polynucleotide encoding a mutated PPO polypeptide according to the present invention, which polynucleotide is capable of being expressed in a plant to thereby provide to that plant tolerance to a uracilpyridine herbicide; and (b) providing a uracilpyridine herbicide.

In a preferred embodiment, said step of providing a polynucleotide comprises providing a plant containing the polynucleotide.

In another preferred embodiment, said step of providing a polynucleotide comprises providing a seed containing the polynucleotide.

In another preferred embodiment, said process further comprises a step of applying the uracilpyridine herbicide to the seed.

In another embodiment, the invention relates to the use of a combination useful for weed control, comprising (a) a polynucleotide encoding a mutated PPO polypeptide according to the present invention, which polynucleotide is capable of being expressed in a plant to thereby provide to that plant tolerance to a uracilpyridine herbicide; and (b) a uracilpyridine herbicide, to control weeds at a plant cultivation site.

BRIEF DESCRIPTION OF THE DRAWINGS (NB: full name of used uracilpyridines is given in the Example section)

Figure 2:
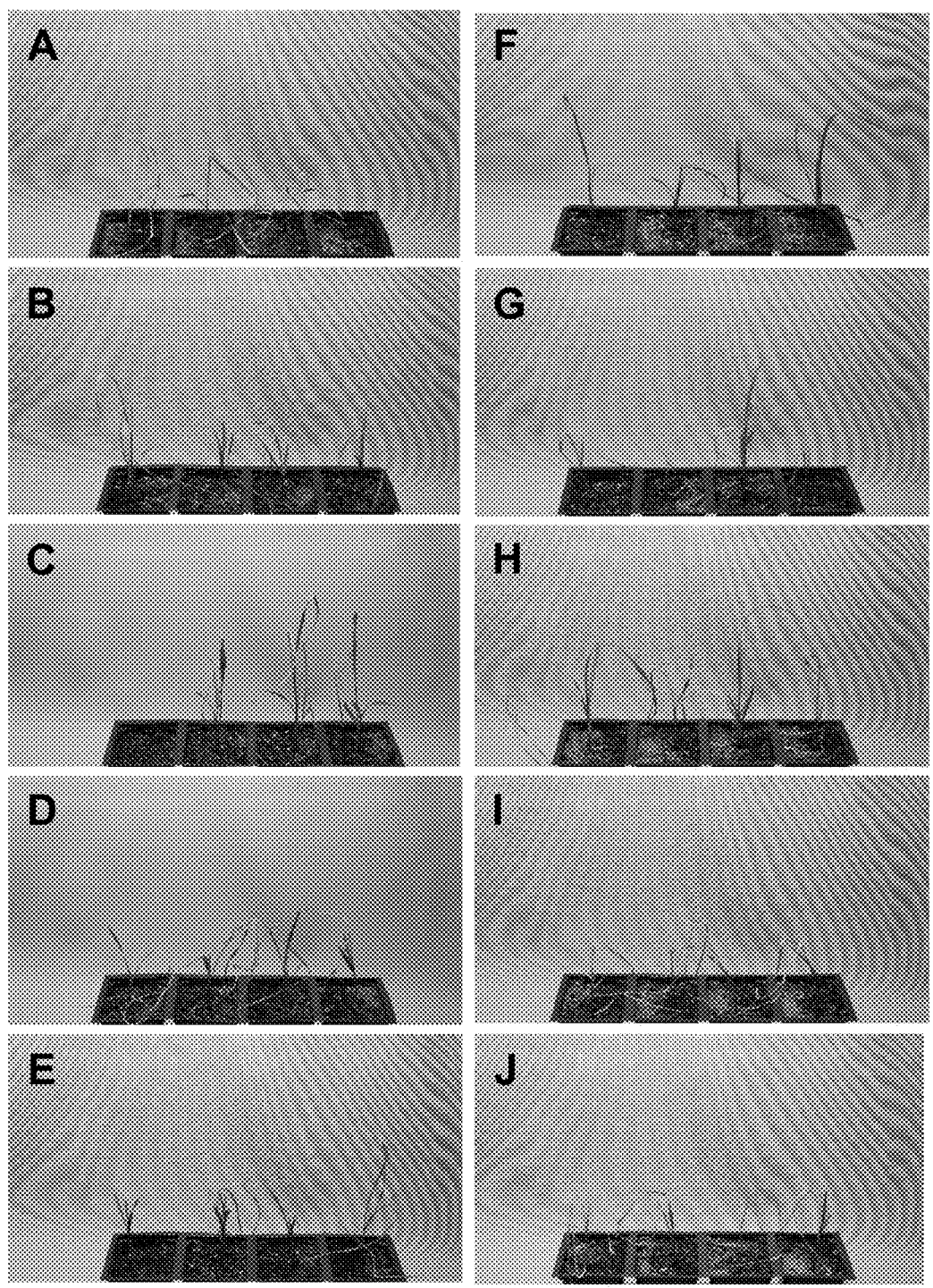

FIG. 1: Rice plants 7 days after treatment with 3.125 g AI/ha of Uracilpyridine 4. A) wild-type, B) R139L mutant, C) R139G mutant, D) G225R mutant, E) G420A mutant, F) F442L mutant, G) F442I mutant, H) F442V mutant, I) L419 mutant, J) L422F mutant FIG. 2: SRice plants 7 days after treatment with 6.25 g AI/ha of Uracilpyridine 2. A) wild-type, B) R139L mutant, C) R139G mutant, D) G225R mutant, E) G420A mutant, F) F442L mutant, G) F442I mutant, H) F442V mutant, 1) L419 mutant, J) L422F mutant.

Figure 3:
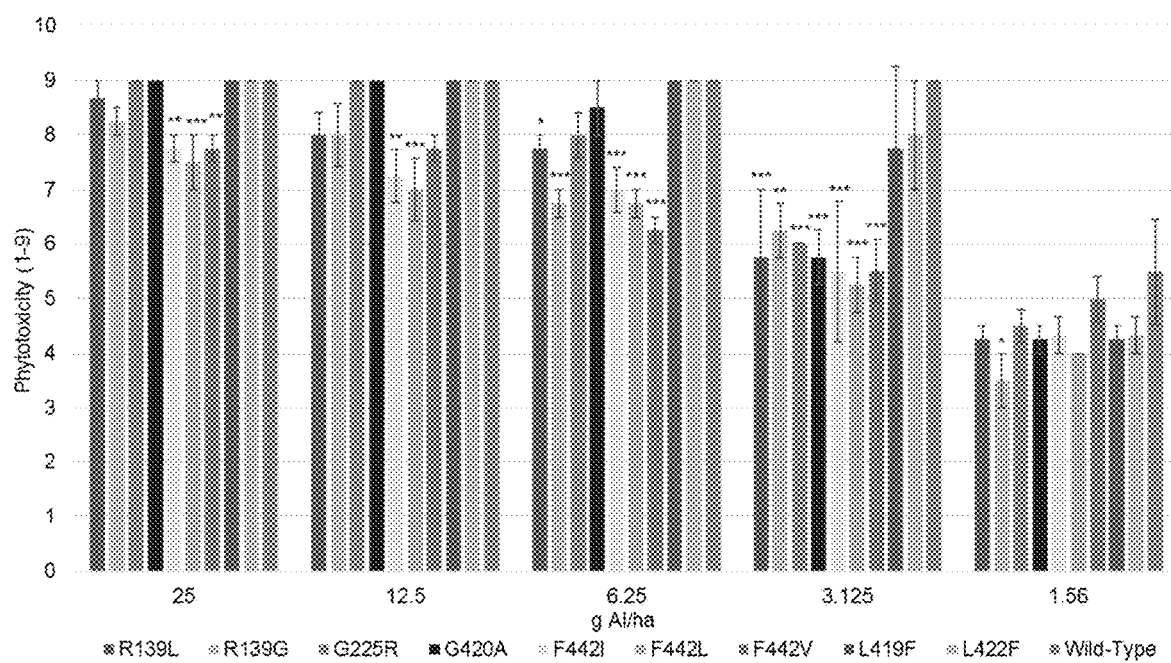
Figure 4:
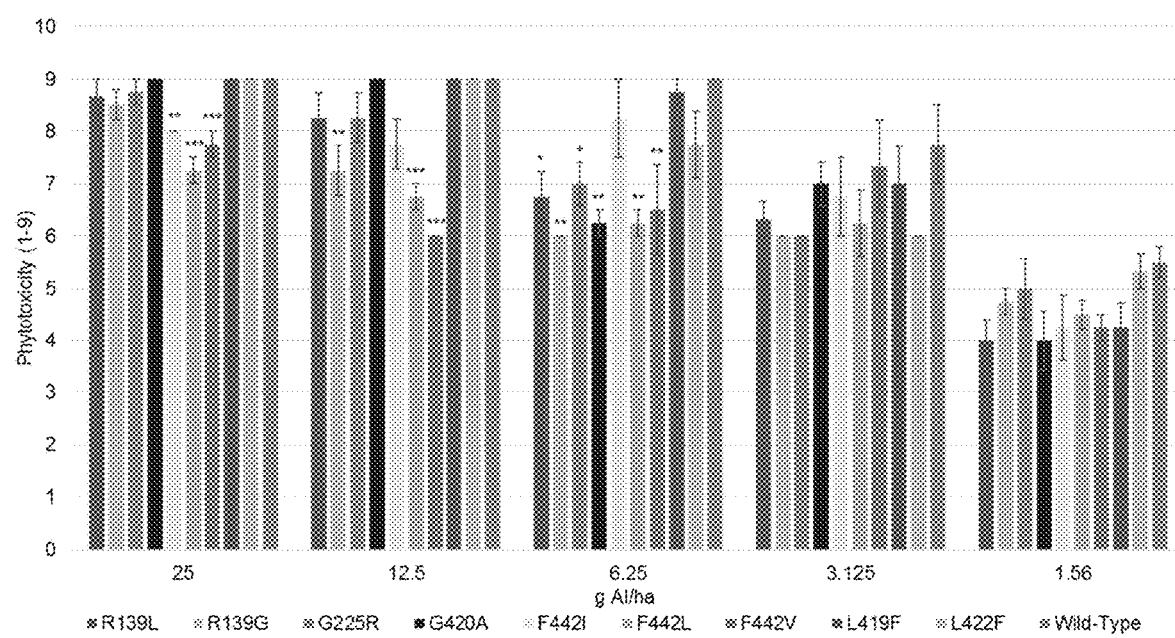

FIG. 3: Response of rice containing mutations in the OsPPO2 gene and wild-type rice to application of Uracilpyridine 4. Each bar represents the average of up to four plants. Phytotoxicity was assessed 7 days after herbicide application. *P-value<0.001, P-value<0.01, *P-value<0.05 as calculated by ANOVA using a QuasiPoisson distribution FIG. 4: Response of rice containing mutations in the OsPPO2 gene and wild-type rice to application of Uracilpyridine 2. Each bar represents the average of up to four plants. Phytotoxicity was assessed 7 days after herbicide application. *P-value<0.001, P-value<0.01, *P-value<0.05 as calculated by ANOVA using a QuasiPoisson distribution.

Figure: Transgenic T2 *Arabidopsis* plants harboring *Arabidopsis* PPO tolerance trait, sprayed post in the greenhouse with the following amounts (80, 30, 10, 5, 1 g/ha from right to left) of Uracilpyridine+1% (v/v) MSO. Pictures taken 14 Days After Treatment (DAT). A) is tested with Uracilpyridine 4, B) is tested with Uracilpyridine 5, C) is tested with Uracilpyridine 2, D) is tested with Uracilpyridine 3.

1=non-transformed *Arabidopsis* plants
   2=Transformants with *Arabidopsis* PPO1 wildtype
   3=Transformants with *Arabidopsis* PPO1 double mutant S305L_Y426M FIG. 6: Transgenic T2 *Arabidopsis* plants harboring various PPO tolerance trait, sprayed post in the greenhouse with the following amounts (200, 100, 50 g/ha) of Uracilpyridine+1% (v/v) MSO. Pictures taken 14 Days After Treatment (DAT). A) is tested with Uracilpyridine 2, B) is tested with Uracilpyridine 4, C) is tested with Uracilpyridine 1, D) is tested with Uracilpyridine 2.

Figure 9:
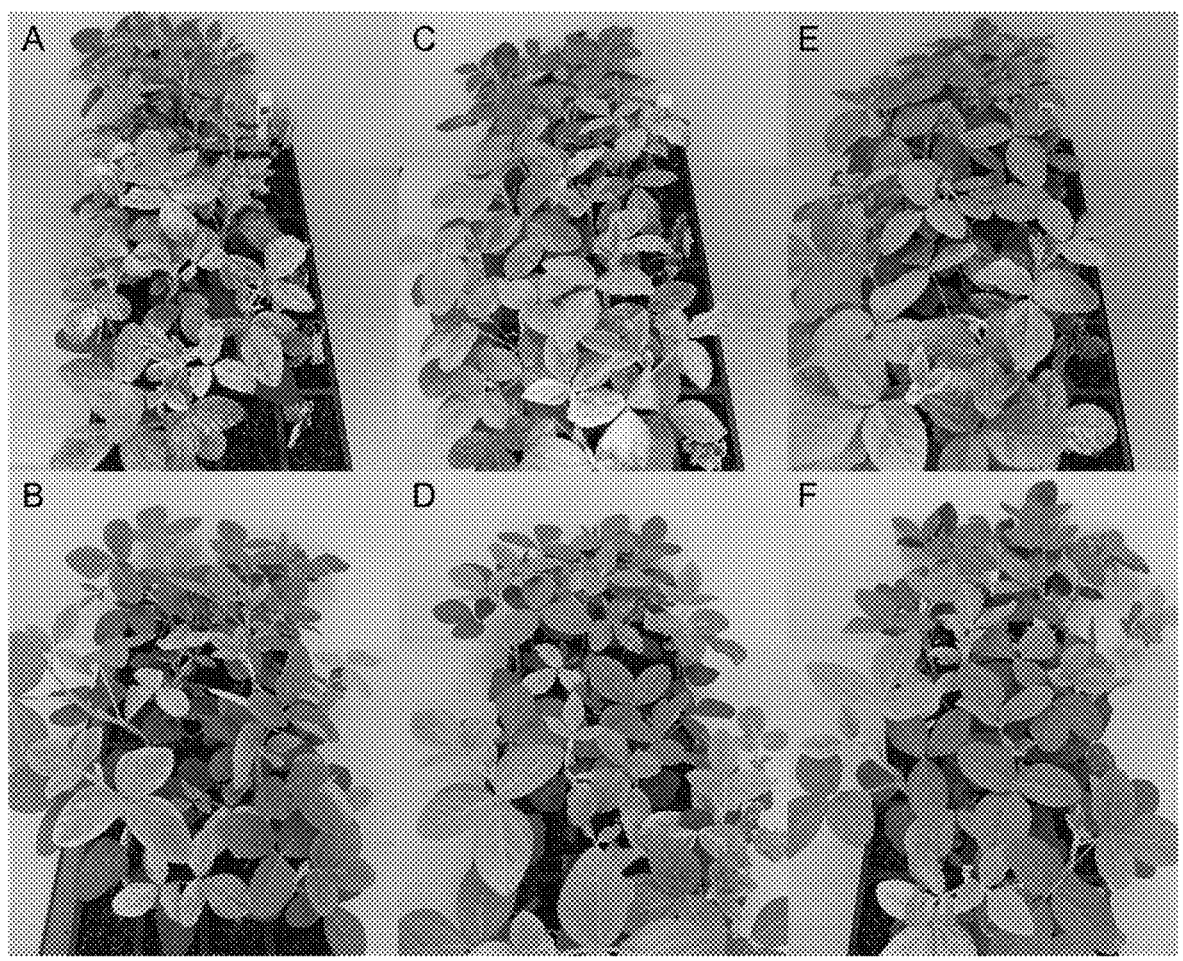

1=non-transformed *Arabidopsis* plants
   2=transformed with AMATU_PPO2_TPL_hemG (event R) (SEQ ID NO: 246)
   3=transformed with AMATU_PPO2_TPL_hemG (event Q) (SEQ ID NO: 246)
   4=transformed with ALOMY_PPO2_TP_hemG (SEQ ID NO: 248)
   5=transformed with ALOMY_PPO2_R137L_F438V
   6=transformed with ALOMY_PPO2_TPL_AMATU_PPO2_R128M_F420I (SEQ ID NO: 258)
   7=transformed with AMATU_PPO2_R128M_F420 I
   8=transformed with AMATU_PPO2_R128A_F420M FIG. 7: Transgenic Corn plants harboring a PPO inhibitor tolerance trait, sprayed post at the V5 leaf stage with 100 g/ha of Uracilpyridine 2+1% (v/v) MSO. Evaluation performed 14 Days After Treatment (DAT) and is shown as injury (%) relative to non-transgenic treated plants. Application performed on corn in V5 leaf stage with 100 g/ha Uracilpyridine 2. Picture taken at 2 DAT 1=Corn transformed with AMATU_PPO2_R128A_F420L
   2=Corn transformed with AMATU_PPO2_R128A_F420
   3=non-transformed corn plants FIG. 8: Transgenic T3 Soybean plants harboring a PPO inhibitor tolerance trait, sprayed post at the V3 leaf stage with 100 g/ha of Uracilpyridine 2+1% (v/v) MSO. Evaluation performed 14 Days After Treatment (DAT) and is shown as injury (%) relative to non-transgenic treated plants. Application performed on soy at V3 leaf stage with 100 g/ha uracilpyridine 2. Picture taken at 2 DAT 1=Soy transformed with AMATU_PPO2_R128A, F420I
   2=Soy transformed with AMATU_PPO2_L397E, F420V
   3=Soy transformed with AMATU_PPO2_L397E, F420M
   4=Soy transformed with AMATU_PPO2_L397Q, F420M
   5=non-transformed soy plants FIG. 9: Transgenic T4 Soybean plants harboring a PPO inhibitor tolerance trait, sprayed with 25 g/ha (Panels A-B), 50 g/ha (Panels C-D), 100 g/ha (Panels E-F) of Uracilpyridine 10+1% (v/v) MSO. Evaluation and pictures taken 7 Days After Treatment. Application performed on soybean 14 days after sowing. Panels A, C, & E each show plants harboring a PPO trait containing R128A+F420L, R128A+ F420I AMTU PPO2 variants as well as untransformed soybean (last column). Panels B, D, & F each show plants harboring a PPO trait containing L397Q+F420V and L397E+F420M AMTU PPO2 variants.

Figure 10:
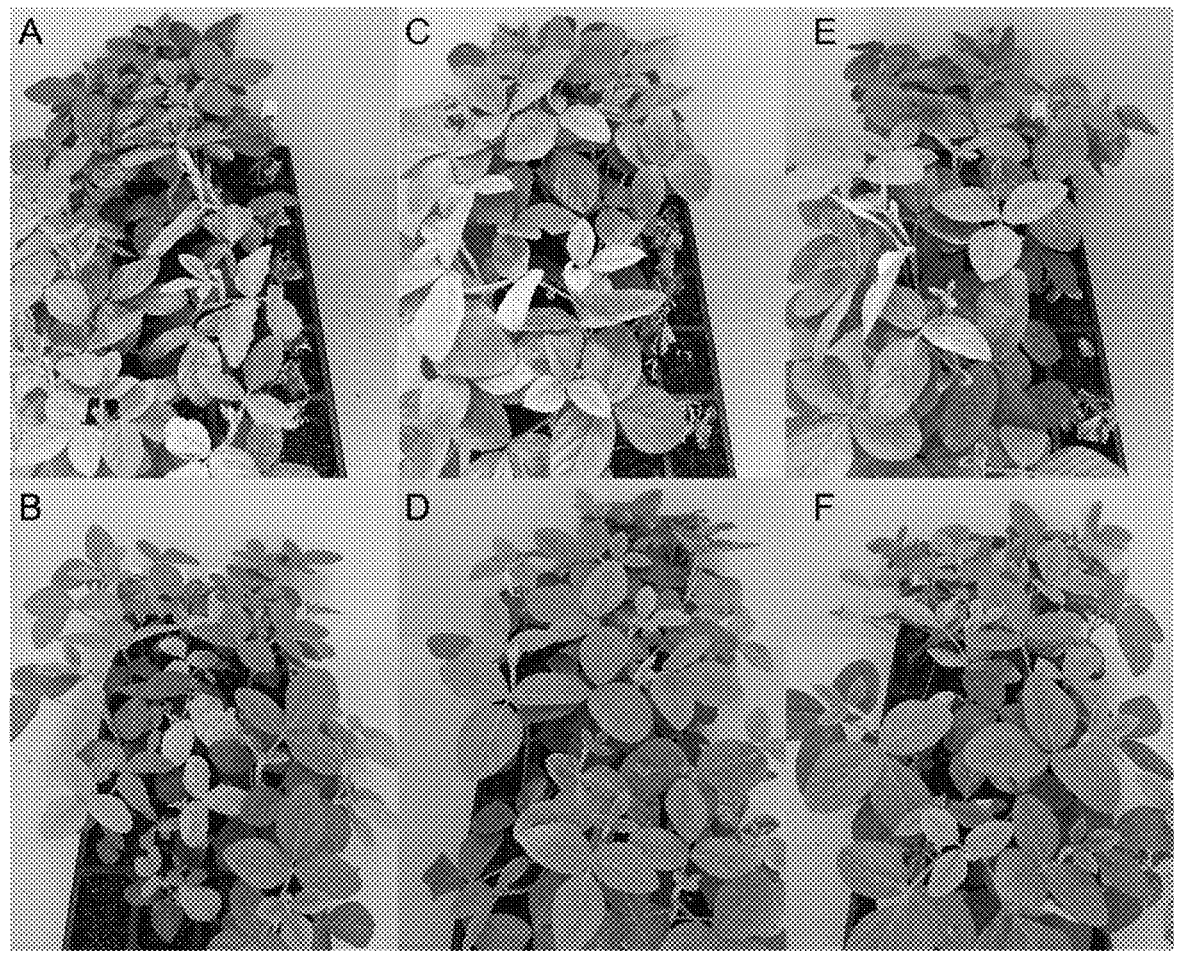

FIG. 10: Transgenic T4 Soybean plants harboring a PPO inhibitor tolerance trait, sprayed with 25 g/ha (Panels A-B), 50 g/ha (Panels C-D), 100 g/ha (Panels E-F) of Uracilpyridine 20+1% (v/v) MSO. Evaluation and pictures taken 7 Days After Treatment. Application performed on soybean 14 days after sowing. Panels A, C, & E each show plants harboring a PPO trait containing R128A+F420L, R128A+ F420I AMTU PPO2 variants as well as untransformed soybean (last column). Panels B, D, & F each show plants harboring a PPO trait containing L397Q+F420V and L397E+F420M AMTU PPO2 variants.

Figure 11:
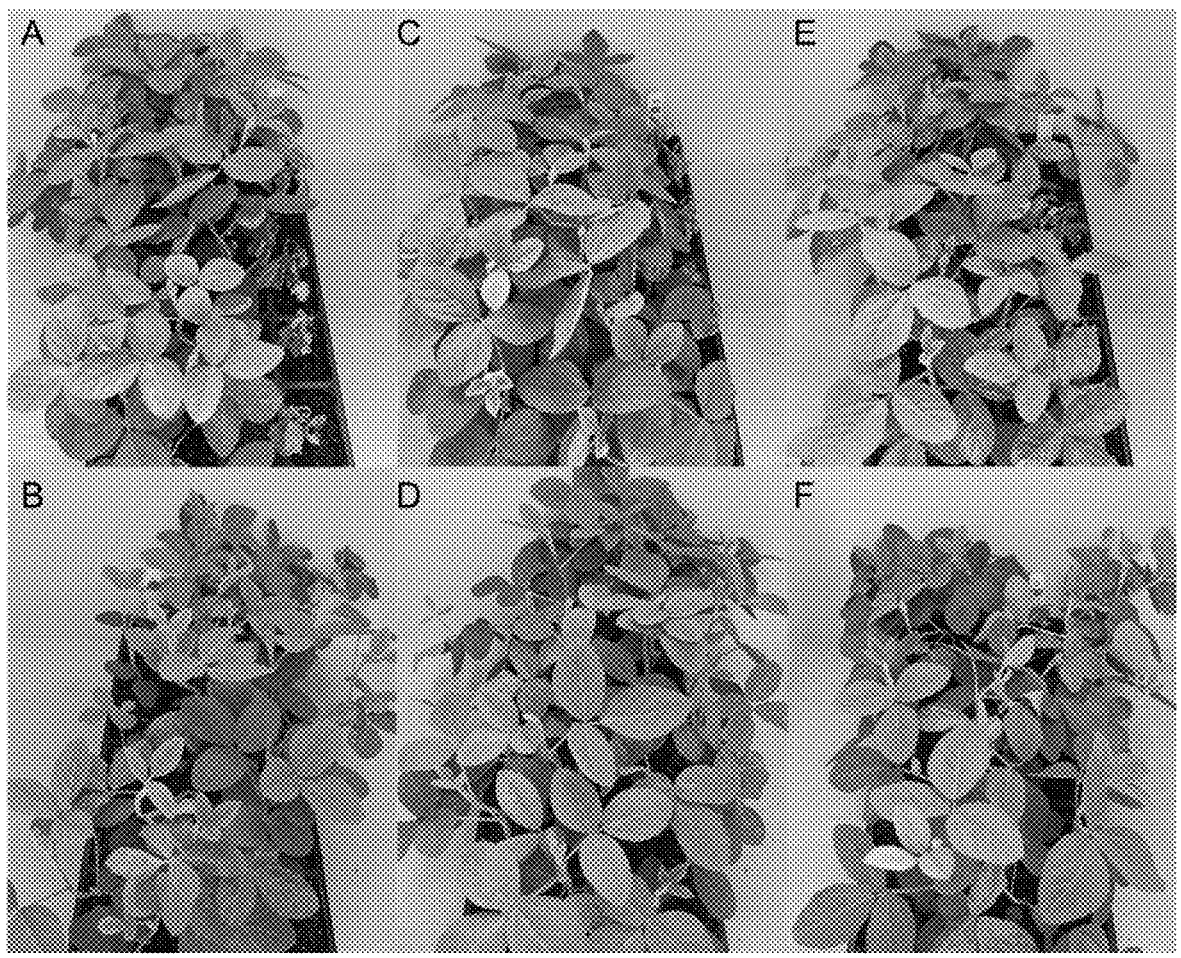

FIG. 11: Transgenic T4 Soybean plants harboring a PPO inhibitor tolerance trait, sprayed with 25 g/ha (Panels A-B), 50 g/ha (Panels C-D), 100 g/ha (Panels E-F) of Uracilpyridine 21+1% (v/v) MSO. Evaluation and pictures taken 7 Days After Treatment. Application performed on soybean 14 days after sowing. Panels A, C, & E each show plants harboring a PPO trait containing R128A+F420L, R128A+ F420I AMTU PPO2 variants as well as untransformed soybean (last column). Panels B, D, & F each show plants harboring a PPO trait containing L397Q+F420V and L397E+F420M AMTU PPO2 variants.

Figure 12:
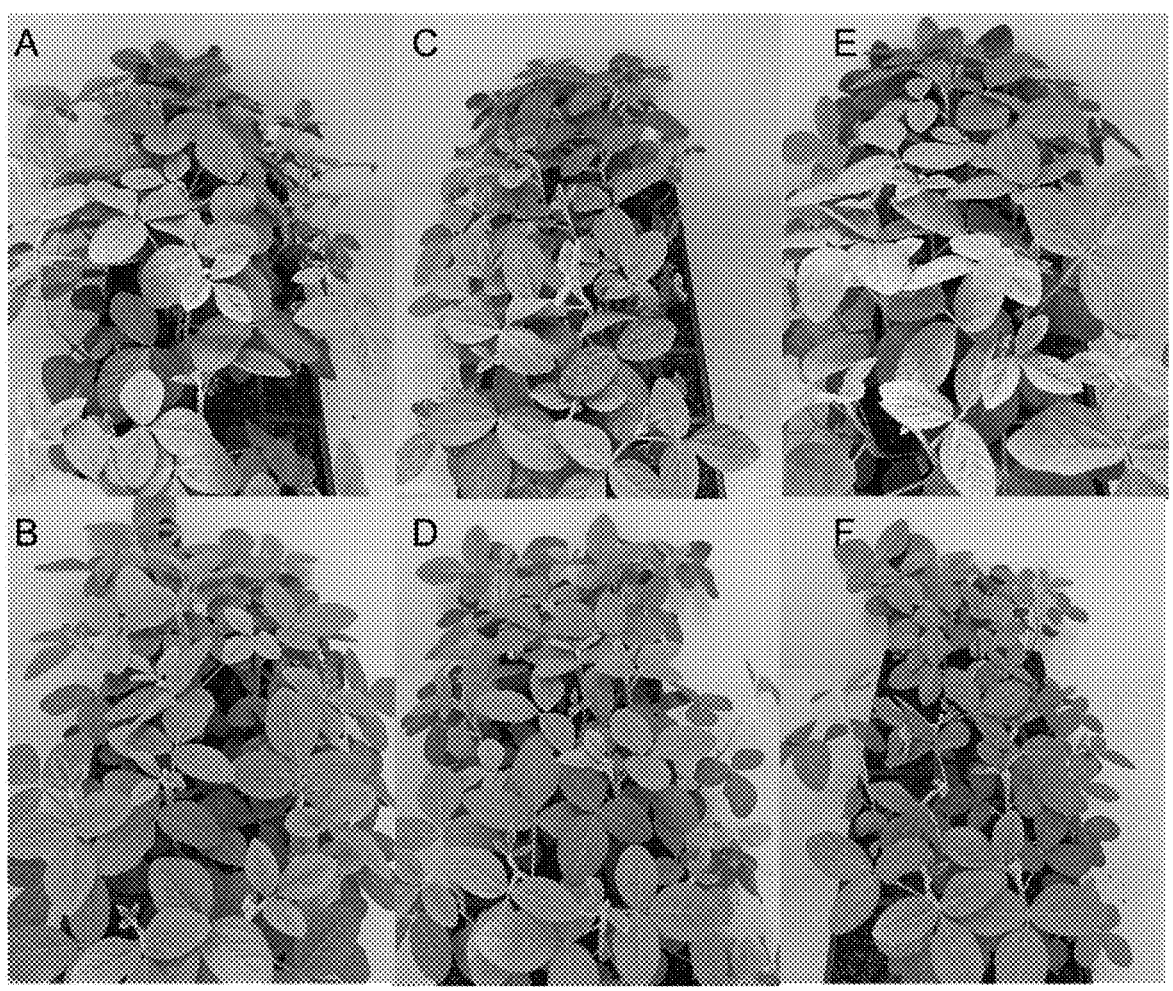

FIG. 12: Transgenic T4 Soybean plants harboring a PPO inhibitor tolerance trait, sprayed with 25 g/ha (Panels A-B), 50 g/ha (Panels C-D), 100 g/ha (Panels E-F) of Uracilpyridine 22+1% (v/v) MSO. Evaluation and pictures taken 7 Days After Treatment. Application performed on soybean 14 days after sowing. Panels A, C, & E each show plants harboring a PPO trait containing R128A+F420L, R128A+ F420I AMTU PPO2 variants as well as untransformed soybean (last column). Panels B, D, & F each show plants harboring a PPO trait containing L397Q+F420V and L397E+F420M AMTU PPO2 variants.

DETAILED DESCRIPTION

The articles "a" and "an" are used herein to refer to one or more than one (i.e., to at least one) of the grammatical object of the article. By way of example, "an element" means one or more elements.

As used herein, the word "comprising," or variations such as "comprises" or "comprising," will be understood to imply the inclusion of a stated element, integer or step, or group of elements, integers or steps, but not the exclusion of any other element, integer or step, or group of elements, integers or steps.

The inventors of the present invention have found, that the tolerance or resistance of a plant to a uracilpyridine herbicide could be remarkably increased by overexpressing a nucleic acid encoding PPO polypeptides described hereinafter.

The present invention refers to a method for controlling undesired vegetation at a plant cultivation site, the method comprising the steps of:

a) providing, at said site, a plant that comprises at least one nucleic acid comprising a nucleotide sequence encoding a protoporphyrinogen oxidase (mutated PPO) which is resistant or tolerant to a PPO-inhibiting herbicide as defined hereinafter, b) applying to said site an effective amount of said herbicide,
wherein the PPO inhibiting herbicide is a uracilpyridine of formula (I)

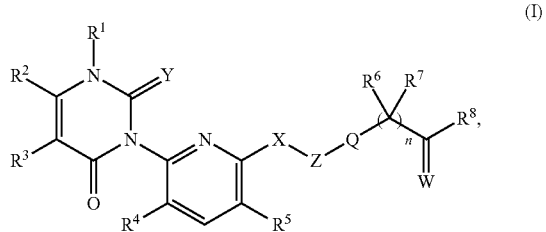

wherein the substituents have the following meanings:
$R^1$ hydrogen, $NH_2$, $C_1$-$C_6$-alkyl or $C_3$-$C_6$-alkynyl;
$R^2$ hydrogen, $C_1$-$C_6$-alkyl or $C_1$-$C_6$-haloalkyl;
$R^3$ hydrogen or $C_1$-$C_6$-alkyl;
$R^4$ H or halogen;
$R^5$ halogen, CN, $NO_2$, $NH_2$, $CF_3$ or C(=S)$NH_2$;
$R^6$ H, halogen, CN, $C_1$-$C_3$-alkyl, $C_1$-$C_3$-haloalkyl, $C_1$-$C_3$-alkoxy, $C_1$-$C_3$-haloalkoxy, $C_1$-$C_3$-alkylthio, ($C_1$-$C_3$-alkyl)amino, di($C_1$-$C_3$-alkyl)amino, $C_1$-$C_3$-alkoxy-$C_1$-$C_3$-alkyl, $C_1$-$C_3$-alkoxycarbonyl;
$R^7$ H, halogen, $C_1$-$C_3$-alkyl, $C_1$-$C_3$-alkoxy;
$R^8$ $OR^9$, $SR^9$, $NR^{10}R^{11}$, $NR^9OR^9$, $NR^9S(O)_2R^{10}$ or $NR^9S(O)_2NR^{10}R^{11}$, wherein
$R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_1$-$C_6$-haloalkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)aminocarbonyl-$C_1$-$C_6$-alkyl, di($C_1$-$C_6$-alkyl)aminocarbonyl-$C_1$-$C_6$-alkyl,
—N=$CR^{12}R^{13}$, wherein $R^{12}$ and $R^{13}$ independently of one another are H, $C_1$-$C_4$-alkyl or phenyl;
$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6 membered heteroaryl,
wherein each cycloalkyl, heterocyclyl, phenyl or heteroaryl ring can be substituted by one to four substituents selected from $R^{14}$ or a 3- to 7-membered carbocyclus,
which carbocyclus optionally has in addition to carbon atoms one or two ring members selected from the group consisting of —N($R^{12}$)—, —N=N—, —C(=O)—, —O— and —S—, and
which carbocyclus is optionally substituted with one to four substituents selected from $R^{14}$;

wherein $R^{14}$ is halogen, $NO_2$, CN, $C_1$-$C_4$-alkyl, $C_1$-$C_4$-haloalkyl, $C_1$-$C_4$-alkoxy or $C_1$-$C_4$-alkoxycarbonyl;
$R^{10}$, $R^{11}$ independently of one another are $R^9$, or together form a 3- to 7-membered carbocyclus,
which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;
n 1 to 3;
Q $CH_2$, O, S, SO, $SO_2$, NH or ($C_1$-$C_3$-alkyl)N;
W O or S;
X NH, $NCH_3$, O or S;
Y O or S;
Z phenyl, pyridyl, pyridazinyl, pyrimidinyl or pyrazinyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy, $C_1$-$C_6$-haloalkoxy;
including their agriculturally acceptable salts or derivatives, provided the compounds of formula (I) have a carboxyl group.

The term "control of undesired vegetation" is to be understood as meaning the killing of weeds and/or otherwise retarding or inhibiting the normal growth of the weeds. Weeds, in the broadest sense, are understood as meaning all those plants which grow in locations where they are undesired, e.g. (crop) plant cultivation sites. The weeds of the present invention include, for example, dicotyledonous and monocotyledonous weeds. Dicotyledonous weeds include, but are not limited to, weeds of the genera: *Sinapis, Lepidium, Galium, Stellaria, Matricaria, Anthemis, Galinsoga, Chenopodium, Urtica, Senecio, Amaranthus, Portulaca, Xanthium, Convolvulus, Ipomoea, Polygonum, Sesbania, Ambrosia, Cirsium, Carduus, Sonchus, Solanum, Rorippa, Rotala, Lindernia, Lamium, Veronica, Abutilon, Emex, Datura, Viola, Galeopsis, Papaver, Centaurea, Trifolium, Ranunculus,* and *Taraxacum.* Monocotyledonous weeds include, but are not limited to, weeds of the genera: *Echinochloa, Setaria, Panicum, Digitaria, Phleum, Poa, Festuca, Eleusine, Brachiaria, Lolium, Bromus, Avena, Cyperus, Sorghum, Agropyron, Cynodon, Monochoria, Fimbristyslis, Sagittaria, Eleocharis, Scirpus, Paspalum, Ischaemum, Sphenoclea, Dactyloctenium, Agrostis, Alopecurus,* and *Apera.* In addition, the weeds of the present invention can include, for example, crop plants that are growing in an undesired location. For example, a volunteer maize plant that is in a field that predominantly comprises soybean plants can be considered a weed, if the maize plant is undesired in the field of soybean plants.

The term "plant" is used in its broadest sense as it pertains to organic material and is intended to encompass eukaryotic organisms that are members of the Kingdom Plantae, examples of which include but are not limited to vascular plants, vegetables, grains, flowers, trees, herbs, bushes, grasses, vines, ferns, mosses, fungi and algae, etc, as well as clones, offsets, and parts of plants used for asexual propagation (e.g. cuttings, pipings, shoots, rhizomes, underground stems, clumps, crowns, bulbs, corms, tubers, rhizomes, plants/tissues produced in tissue culture, etc.). The term "plant" further encompasses whole plants, ancestors and progeny of the plants and plant parts, including seeds, shoots, stems, leaves, roots (including tubers), flowers, florets, fruits, pedicles, peduncles, stamen, anther, stigma, style, ovary, petal, sepal, carpel, root tip, root cap, root hair, leaf hair, seed hair, pollen grain, microspore, cotyledon, hypocotyl, epicotyl, xylem, phloem, parenchyma, endosperm, a companion cell, a guard cell, and any other known organs, tissues, and cells of a plant, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja* max), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus* indica, *Theobroma cacao*, *Trifolium* spp., *Tripsacum dactyloides*, *Triticosecale rimpaui*, *Triticum* spp. (e.g. *Triticum aestivum*, *Triticum durum*, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amaranth, artichoke, asparagus, broccoli, Brussels sprouts, cabbage, canola, carrot, cauliflower, celery, collard greens, flax, kale, lentil, oilseed rape, okra, onion, potato, rice, soybean, strawberry, sugar beet, sugar cane, sunflower, tomato, squash, tea and algae, amongst others. According to a preferred embodiment of the present invention, the plant is a crop plant. Examples of crop plants include inter ala soybean, sunflower, canola, alfalfa, rapeseed, cotton, tomato, potato or tobacco. Further preferably, the plant is a monocotyledonous plant, such as sugarcane. Further preferably, the plant is a cereal, such as rice, maize, wheat, barley, millet, rye, sorghum or oats.

In a preferred embodiment, the plant has been previously produced by a process comprising recombinantly preparing a plant by introducing and over-expressing a wild-type or mutated PPO transgene according to the present invention, as described in greater detail hereinfter.

In another preferred embodiment, the plant has been previously produced by a process comprising in situ mutagenizing plant cells, to obtain plant cells which express a mutated PPO.

As disclosed herein, the nucleic acids of the invention find use in enhancing the herbicide tolerance of plants that comprise in their genomes a gene encoding a herbicide-tolerant wild-type or mutated PPO protein. Such a gene may be an endogenous gene or a transgene, as described hereinafter.

Therefore, in another embodiment the present invention refers to a method of increasing or enhancing the uracilpyridine herbicide tolerance or resistance of a plant, the method comprising overexpressing a nucleic acid encoding a PPO polypeptide which comprises one or more of the following motifs 1, 2, and/or 3:
  a. Motif 1: SQ[N/K/H]KRYI, wherein the Arg at position 5 within said motif is substituted by any other amino acid;
  b. Motif 2: TLGTLFSS, wherein the Leu at position 2 and/or the Gly at position 3, and/or the Leu at position 5 within said motif is substituted by any other amino acid;
  c. Motif 3: [F/Y]TTF[V/I]GG, wherein the Phe at position 4 within said motif is substituted by any other amino acid.

In another embodiment the present invention refers to a method of increasing or enhancing the uracilpyridine herbicide tolerance or resistance of a plant, the method comprising overexpressing a nucleic acid encoding a herbicide resistant or tolerant PPO polypeptide which comprises a variant of the amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, which variant comprises one or more of the following substitutions:
  a. the amino acid corresponding to Arg128 of SEQ ID NO: 1 is substituted by any other amino acid.

b. The amino acid corresponding to Gly211 of SEQ ID NO: 1 is substituted by any other amino acid
c. the amino acid corresponding to Leu397 of SEQ ID NO: 1 is substituted by any other amino acid
d. the amino acid corresponding to Gly398 of SEQ ID NO: 1 is substituted by any other amino acid
e. the amino acid corresponding to Leu400 of SEQ ID NO: 1 is substituted by any other amino acid
f. the amino acid corresponding to Phe420 of SEQ ID NO: 1 is substituted by any other amino acid.

In another embodiment the present invention refers to a method of increasing or enhancing the uracilpyridine herbicide tolerance or resistance of a plant, the method comprising overexpressing a nucleic acid encoding a herbicide resistant or tolerant PPO polypeptide which comprises the amino acid sequence of SEQ ID NO: 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, or a variant thereof.

In another embodiment the present invention refers to a method of increasing or enhancing the uracilpyridine herbicide tolerance or resistance of a plant, the method comprising overexpressing a nucleic acid encoding a herbicide resistant or tolerant PPO polypeptide which comprises the amino acid sequence of SEQ ID NO: 240, 241, 242, 243, 244, 245, 246, 247, 248, 249, 250, 251, 252, 253, 254, 255, 256, 257, 258, 259, 260, 261, 262, or 264.

Additionally, in certain embodiments, the nucleic acids of the present invention can be stacked with any combination of polynucleotide sequences of interest in order to create plants with a desired phenotype. For example, the nucleic acids of the present invention may be stacked with any other polynucleotides encoding polypeptides having pesticidal and/or insecticidal activity, such as, for example, the Bacillus thuringiensis toxin proteins (described in U.S. Pat. Nos. 5,366,892; 5,747,450; 5,737,514; 5,723,756; 5,593,881; and Geiser et al (1986) Gene 48: 109), By way of example, polynucleotides that may be stacked with the nucleic acids of the present invention include nucleic acids encoding polypeptides conferring resistance to pests/pathogens such as viruses, nematodes, insects or fungi, and the like. Exemplary polynucleotides that may be stacked with nucleic acids of the invention include polynucleotides encoding: polypeptides having pesticidal and/or insecticidal activity, such as other *Bacillus thuringiensis* toxic proteins (described in U.S. Pat. Nos. 5,366,892; 5,747,450; 5,737, 514; 5,723,756; 5,593,881; and Geiser et al., (1986) Gene 48:109), lectins (Van Damme et al. (1994) Plant Mol. Biol. 24:825, pentin (described in U.S. Pat. No. 5,981,722), and the like; traits desirable for disease or herbicide resistance (e.g., fumonisin detoxification genes (U.S. Pat. No. 5,792, 931); avirulence and disease resistance genes (Jones et al. (1994) Science 266:789; Martin et al., (1993) Science 262: 1432; Mindrinos et al. (1994) Cell 78:1089); acetolactate synthase (ALS) mutants that lead to herbicide resistance such as the S4 and/or Hra mutations; glyphosate resistance (e.g., 5-enol-pyrovyl-shikimate-3-phosphate-synthase (EPSPS) gene, described in U.S. Pat. Nos. 4,940,935 and 5,188,642; or the glyphosate N-acetyltransferase (GAT) gene, described in Castle et al. (2004) Science, 304:1151-1154; and in U.S. Patent App. Pub. Nos. 20070004912, 20050246798, and 20050060767)); glufosinate resistance (e.g, phosphinothricin acetyl transferase genes PAT and BAR, described in U.S. Pat. Nos. 5,561,236 and 5,276,268); resistance to herbicides including sulfonyl urea, DHT (2, 4D), and PPO herbicides (e.g., glyphosate acetyl transferase, aryloxy alkanoate dioxygenase, acetolactate synthase, and protoporphyrinogen oxidase); a cytochrome P450 or variant thereof that confers herbicide resistance or tolerance to, inter alia, HPPD herbicides (U.S. patent application Ser. No. 12/156,247; U.S. Pat. Nos. 6,380,465; 6,121,512; 5,349, 127; 6,649,814; and 6,300,544; and PCT Patent App. Pub. No. WO2007000077); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) J. Bacteriol. 170:5837-5847) facilitate expression of polyhydroxyalkanoates (PHAs)); the disclosures of which are herein incorporated by reference.

In a preferred embodiment, the plant comprises at least one additional heterologous nucleic acid comprising a nucleotide sequence encoding a herbicide tolerance enzyme selected, for example, from the group consisting of 5-enolpyruvylshikimate-3-phosphate synthase (EPSPS), Glyphosate acetyl transferase (GAT), cytochrome P450 monooxygenase, phosphinothricin acetyltransferase (PAT), Acetohydroxyacid synthase (AHAS; EC 4.1.3.18, also known as acetolactate synthase or ALS), hydroxyphenyl pyruvate dioxygenase (HPPD), Phytoene desaturase (PD) and dicamba degrading enzymes as disclosed in WO 02/068607, or phenoxyaceticacid- and phenoxypropionicacid-derivative degrading enzymes as disclosed in WO 2008141154 or WO 2005107437. The combinations generated can also include multiple copies of any one of the polynucleotides of interest.

Generally, the term "herbicide" is used herein to mean an active ingredient that kills, controls or otherwise adversely modifies the growth of plants. The preferred amount or concentration of the herbicide is an "effective amount" or "effective concentration." By "effective amount" and "effective concentration" is intended an amount and concentration, respectively, that is sufficient to kill or inhibit the growth of a similar, wild-type, plant, plant tissue, plant cell, or host cell, but that said amount does not kill or inhibit as severely the growth of the herbicide-resistant plants, plant tissues, plant cells, and host cells of the present invention. Typically, the effective amount of a herbicide is an amount that is routinely used in agricultural production systems to kill weeds of interest. Such an amount is known to those of ordinary skill in the art. Herbicidal activity is exhibited by herbicides useful for the present invention when they are applied directly to the plant or to the locus of the plant at any stage of growth or before planting or emergence. The effect observed depends upon the plant species to be controlled, the stage of growth of the plant, the application parameters of dilution and spray drop size, the particle size of solid components, the environmental conditions at the time of use, the specific compound employed, the specific adjuvants and carriers employed, the soil type, and the like, as well as the amount of chemical applied. These and other factors can be adjusted as is known in the art to promote non-selective or selective herbicidal action. Generally, it is preferred to apply the herbicide postemergence to relatively immature undesirable vegetation to achieve the maximum control of weeds.

By a "herbicide-tolerant" or "herbicide-resistant" plant, it is intended that a plant that is tolerant or resistant to at least one herbicide at a level that would normally kill, or inhibit the growth of, a normal or wild-type plant. By "herbicide-tolerant wildtype or mutated PPO protein" or "herbicide-resistant wildtype or mutated PPO protein", it is intended that such a PPO protein displays higher PPO activity, relative to the PPO activity of a wild-type PPO protein, when in the presence of at least one herbicide that is known to interfere with PPO activity and at a concentration or level of the herbicide that is known to inhibit the PPO activity of the wild-type mutated PPO protein. Furthermore, the PPO activity of such a herbicide-tolerant or herbicide-resistant mutated PPO protein may be referred to herein as "herbicide-tolerant" or "herbicide-resistant" PPO activity.

In a particularly preferred embodiment, the herbicides useful for the present invention refer uracilpyridines of formula (I)

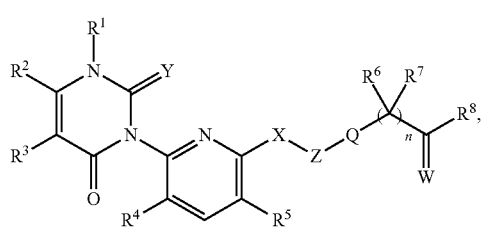

(I)

wherein the substituents have the following meanings:
$R^1$ hydrogen, $NH_2$, $C_1$-$C_6$-alkyl or $C_3$-$C_6$-alkynyl;
$R^2$ hydrogen, $C_1$-$C_6$-alkyl or $C_1$-$C_6$-haloalkyl;
$R^3$ hydrogen or $C_1$-$C_6$-alkyl;
$R^4$ H or halogen;
$R^5$ halogen, CN, $NO_2$, $NH_2$, $CF_3$ or C(=S)$NH_2$;
$R^6$ H, halogen, CN, $C_1$-$C_3$-alkyl, $C_1$-$C_3$-haloalkyl, $C_1$-$C_3$-alkoxy, $C_1$-$C_3$-haloalkoxy, $C_1$-$C_3$-alkylthio, ($C_1$-$C_3$-alkyl)amino, di($C_1$-$C_3$-alkyl)amino, $C_1$-$C_3$-alkoxy-$C_1$-$C_3$-alkyl, $C_1$-$C_3$-alkoxycarbonyl;
$R^7$ H, halogen, $C_1$-$C_3$-alkyl, $C_1$-$C_3$-alkoxy;
$R^8$ $OR^9$, $SR^9$, $NR^{10}R^{11}$, $NR^9OR^9$, $NR^9S(O)_2R^{10}$ or $NR^9S(O)_2NR^{10}R^{11}$, wherein
$R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_1$-$C_6$-haloalkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)aminocarbonyl-$C_1$-$C_6$-alkyl, di($C_1$-$C_6$-alkyl)aminocarbonyl-$C_1$-$C_6$-alkyl,
—N=$CR^{12}R^{13}$, wherein $R^{12}$ and $R^{13}$ independently of one another are H, $C_1$-$C_4$-alkyl or phenyl;
$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6 membered heteroaryl,
wherein each cycloalkyl, heterocyclyl, phenyl or heteroaryl ring can be substituted by one to four substituents selected from $R^{14}$ or a 3- to 7-membered carbocyclus,
which carbocyclus optionally has in addition to carbon atoms one or two ring members selected from the group consisting of —N($R^{12}$)—, —N=N—, —C(=O)—, —O— and —S—, and
which carbocyclus is optionally substituted with one to four substituents selected from $R^{14}$;
wherein $R^{14}$ is halogen, $NO_2$, CN, $C_1$-$C_4$-alkyl, $C_1$-$C_4$-haloalkyl, $C_1$-$C_4$-alkoxy or $C_1$-$C_4$-alkoxycarbonyl;
$R^{10}$, $R^{11}$ independently of one another are $R^9$, or together form a 3- to 7-membered carbocyclus,
which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;
n 1 to 3;
Q $CH_2$, O, S, SO, $SO_2$, NH or ($C_1$-$C_3$-alkyl)N;
W O or S;
X NH, $NCH_3$, O or S;
Y O or S;
Z phenyl, pyridyl, pyridazinyl, pyrimidinyl or pyrazinyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy, $C_1$-$C_6$-haloalkoxy;
including their agriculturally acceptable salts or derivatives, provided the compounds of formula (I) have a carboxyl group.

If the uracilpyridines of formula (I), the herbicidal compounds B and/or the safeners C as described herein are capable of forming geometrical isomers, for example E/Z isomers, it is possible to use both, the pure isomers and mixtures thereof, in the compositions according to the invention.

If the uracilpyridines of formula (I), the herbicidal compounds B and/or the safeners C as described herein have one or more centres of chirality and, as a consequence, are present as enantiomers or diastereomers, it is possible to use both, the pure enantiomers and diastereomers and their mixtures, in the compositions according to the invention.

Within the substituents of the uracilpyridines of formula (I), instead of hydrogene also the corresponding isotope deuterium can be used.

If the uracilpyridines of formula (I), the herbicidal compounds B and/or the safeners C as described herein have ionizable functional groups, they can also be employed in the form of their agriculturally acceptable salts. Suitable are, in general, the salts of those cations and the acid addition salts of those acids whose cations and anions, respectively, have no adverse effect on the activity of the active compounds.

Preferred cations are the ions of the alkali metals, preferably of lithium, sodium and potassium, of the alkaline earth metals, preferably of calcium and magnesium, and of the transition metals, preferably of manganese, copper, zinc and iron, further ammonium and substituted ammonium in which one to four hydrogen atoms are replaced by $C_1$-$C_4$-alkyl, hydroxy-$C_1$-$C_4$-alkyl, $C_1$-$C_4$-alkoxy-$C_1$-$C_4$-alkyl, hydroxy-$C_1$-$C_4$-alkoxy-$C_1$-$C_4$-alkyl, phenyl or benzyl, preferably ammonium, methylammonium, isopropylammonium, dimethylammonium, diethylammonium, diisopropylammonium, trimethylammonium, triethylammonium, tris(isopropyl)ammonium, heptylammonium, dodecylammonium, tetradecylammonium, tetramethylammonium, tetraethylammonium, tetrabutylammonium, 2-hydroxyethylammonium (olamine salt), 2-(2-hydroxyeth-1-oxy)eth-1-ylammonium (diglycolamine salt), di(2-hydroxyeth-1-yl)ammonium (diolamine salt), tris(2-hydroxyethyl)ammonium (trolamine salt), tris(2-hydroxypropyl)ammonium, benzyltrimethylammonium, benzyltriethylammonium, N,N,N-trimethylethanolammonium (choline salt), furthermore phosphonium ions, sulfonium ions, preferably tri($C_1$-$C_4$-alkyl)sulfonium, such as trimethylsulfonium, and sulfoxonium ions, preferably tri($C_1$-$C_4$-alkyl)sulfoxonium, and finally the salts of polybasic amines such as N,N-bis-(3-aminopropyl)methylamine and diethylenetriamine.

Also preferred cations are the ions of the alkali metals, preferably of lithium, sodium and potassium, of the alkaline earth metals, preferably of calcium and magnesium, and of the transition metals, preferably of manganese, copper, zinc and iron, further ammonium and substituted ammonium in which one to four hydrogen atoms are replaced by $C_1$-$C_4$-alkyl, hydroxy-$C_1$-$C_4$-alkyl, $C_1$-$C_4$-alkoxy-$C_1$-$C_4$-alkyl, hydroxy-$C_1$-$C_4$-alkoxy-$C_1$-$C_4$-alkyl, phenyl or benzyl, preferably ammonium, methylammonium, isopropylammonium, dimethylammonium, diisopropylammonium, trimethylammonium, heptylammonium, dodecylammonium, tetradecylammonium, tetramethylammonium, tetraethylammonium, tetrabutylammonium, 2-hydroxyethylammonium (olamine salt), 2-(2-hydroxyeth-1-oxy)eth-1-ylammonium (diglycolamine salt), di(2-hydroxyeth-1-yl)ammonium (diolamine salt), tris(2-hydroxyethyl)ammonium (trolamine salt), tris(2-hydroxypropyl)ammonium, benzyltrimethylammonium, benzyltriethylammonium, N,N,N-trimethylethanolammonium (choline salt), furthermore phosphonium ions, sulfonium ions, preferably tri($C_1$-$C_4$-alkyl)sulfonium, such as trimethylsulfonium, and sulfoxonium ions, preferably tri($C_1$-$C_4$-alkyl)sulfoxonium, and finally the salts of polybasic amines such as N,N-bis-(3-aminopropyl)methylamine and diethylenetriamine.

Anions of useful acid addition salts are primarily chloride, bromide, fluoride, iodide, hydrogensulfate, methylsulfate, sulfate, dihydrogenphosphate, hydrogenphosphate, nitrate, bicarbonate, carbonate, hexafluorosilicate, hexafluorophosphate, benzoate and also the anions of $C_1$-$C_4$-alkanoic acids, preferably formate, acetate, propionate and butyrate.

Uracilpyridines of formula (I), herbicidal compounds B and/or safeners C as described herein having a carboxyl group can be employed in the form of the acid, in the form of an agriculturally suitable salt as mentioned above or else in the form of an agriculturally acceptable derivative, for example as amides, such as mono- and di-$C_1$-$C_6$-alkylamides or arylamides, as esters, for example as allyl esters, propargyl esters, $C_1$-$C_{10}$-alkyl esters, alkoxyalkyl esters, tefuryl ((tetrahydrofuran-2-yl)methyl) esters and also as thioesters, for example as $C_1$-$C_{10}$-alkylthio esters. Preferred mono- and di-$C_1$-$C_6$-alkylamides are the methyl and the dimethylamides. Preferred arylamides are, for example, the anilides and the 2-chloroaniides. Preferred alkyl esters are, for example, the methyl, ethyl, propyl, isopropyl, butyl, isobutyl, pentyl, mexyl (1-methylhexyl), meptyl (1-methylheptyl), heptyl, octyl or isooctyl (2-ethylhexyl) esters. Preferred $C_1$-$C_4$-alkoxy-$C_1$-$C_4$-alkyl esters are the straight-chain or branched $C_1$-$C_4$-alkoxy ethyl esters, for example the 2-methoxyethyl, 2-ethoxyethyl, 2-butoxyethyl (butotyl), 2-butoxypropyl or 3-butoxypropyl ester. An example of a straight-chain or branched $C_1$-$C_{10}$-alkylthio ester is the ethylthio ester.

The organic moieties mentioned in the definition of the variables $R^1$ to $R^{14}$ and $R^a$ to $R^e$, are—like the term halogen—collective terms for individual enumerations of the individual group members. The term halogen denotes in each case fluorine, chlorine, bromine or iodine. All hydrocarbon chains, e.g. all alkyl, alkenyl, alkynyl, alkoxy chains, can be straight-chain or branched, the prefix $C_n$-$C_m$ denoting in each case the possible number of carbon atoms in the group.

Examples of such meanings are:

$C_1$-$C_3$-alkyl and also the $C_1$-$C_3$-alkyl moieties of di($C_1$-$C_3$-alkyl)amino, $C_1$-$C_3$-alkoxy-$C_1$-$C_3$-alkyl: for example $CH_3$, $C_2H_5$, n-propyl and $CH(CH_3)_2$;

$C_1$-$C_4$-alkyl and also the $C_1$-$C_4$-alkyl moieties of phenyl-$C_1$-$C_4$-alkyl: for example $CH_3$, $C_2H_5$, n-propyl, $CH(CH_3)_2$, n-butyl, $CH(CH_3)$—$C_2H_5$, $CH_2$—$CH(CH_3)_2$ and $C(CH_3)_3$;

$C_1$-$C_6$-alkyl and also the $C_1$-$C_6$-alkyl moieties of $C_1$-$C_6$-cyanoalkyl, $C_1$-$C_6$-alkyoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_1$-$C_6$-haloalkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)aminocarbonyl-$C_1$-$C_6$-alkyl, di($C_1$-$C_6$-alkyl)aminocarbonyl-$C_1$-$C_6$-alkyl, $C_3$-$C_6$-cycloalkyl-$C_1$-$C_6$-alkyl, $C_3$-$C_6$-heterocyclyl-$C_1$-$C_6$-alkyl: $C_1$-$C_4$-alkyl as mentioned above, and also, for example, n-pentyl, 1-methylbutyl, 2-methylbutyl, 3-methylbutyl, 2,2-dimethylpropyl, 1-ethylpropyl, n-hexyl, 1,1-dimethylpropyl, 1,2-dimethylpropyl, 1-methylpentyl, 2-methylpentyl, 3-methylpentyl, 4-methylpentyl, 1,1-dimethylbutyl, 1,2-dimethylbutyl, 1,3-dimethylbutyl, 2,2-dimethylbutyl, 2,3-dimethylbutyl, 3,3-dimethylbutyl, 1-ethylbutyl, 2-ethylbutyl, 1,1,2-trimethylpropyl, 1,2,2-trimethylpropyl, 1-ethyl-1-methylpropyl or 1-ethyl-2-methylpropyl, preferably methyl, ethyl, n-propyl, 1-methylethyl, n-butyl, 1,1-dimethylethyl, n-pentyl or n-hexyl;

$C_1$-$C_3$-haloalkyl: $C_1$-$C_3$-alkyl as mentioned above which is partially or fully substituted by fluorine, chlorine, bromine and/or iodine, for example, chloromethyl, dichloromethyl, trichloromethyl, fluoromethyl, difluoromethyl, trifluoromethyl, chlorofluoromethyl, dichlorofluoromethyl, chlorodifluoromethyl, bromomethyl, iodomethyl, 2-fluoroethyl, 2-chloroethyl, 2-bromoethyl, 2-iodoethyl, 2,2-difluoroethyl, 2,2,2-trifluoroethyl, 2-chloro-2-fluoroethyl, 2-chloro-2,2-difluoroethyl, 2,2-dichloro-2-fluoroethyl, 2,2,2-trichloroethyl, pentafluoroethyl, 2-fluoropropyl, 3-fluoropropyl, 2,2-difluoropropyl, 2,3-difluoropropyl, 2-chloropropyl, 3-chloropropyl, 2,3-dichloropropyl, 2-bromopropyl, 3-bromopropyl, 3,3,3-trifluoropropyl, 3,3,3-trichloropropyl, 2,2,3,3,3-pentafluoropropyl, heptafluoropropyl, 1-(fluoromethyl)-2-fluoroethyl, 1-(chloromethyl)-2-chloroethyl, 1-(bromomethyl)-2-bromoethyl;

$C_1$-$C_4$-haloalkyl: $C_1$-$C_4$-alkyl as mentioned above which is partially or fully substituted by fluorine, chlorine, bromine and/or iodine, for example, chloromethyl, dichloromethyl, trichloromethyl, fluoromethyl, difluoromethyl, trifluoromethyl, chlorofluoromethyl, dichlorofluoromethyl, chlorodifluoromethyl, bromomethyl, iodomethyl, 2-fluoroethyl, 2-chloroethyl, 2-bromoethyl, 2-iodoethyl, 2,2-difluoroethyl, 2,2,2-trifluoroethyl, 2-chloro-2-fluoroethyl, 2-chloro-2,2-difluoroethyl, 2,2-dichloro-2-fluoroethyl, 2,2,2-trichloroethyl, pentafluoroethyl, 2-fluoropropyl, 3-fluoropropyl, 2,2-difluoropropyl, 2,3-difluoropropyl, 2-chloropropyl, 3-chloropropyl, 2,3-dichloropropyl, 2-bromopropyl, 3-bromopropyl, 3,3,3-trifluoropropyl, 3,3,3-trichloropropyl, 2,2,3,3,3-pentafluoropropyl, heptafluoropropyl, 1-(fluoromethyl)-2-fluoroethyl, 1-(chloromethyl)-2-chloroethyl, 1-(bromomethyl)-2-bromoethyl, 4-fluorobutyl, 4-chlorobutyl, 4-bromobutyl, nonafluorobutyl, 1,1,2,2,-tetrafluoroethyl and 1-trifluoromethyl-1,2,2,2-tetrafluoroethyl;

$C_1$-$C_6$-haloalkyl: $C_1$-$C_4$-haloalkyl as mentioned above, and also, for example, 5-fluoropentyl, 5-chloropentyl, 5-bromopentyl, 5-iodopentyl, undecafluoropentyl, 6-fluorohexyl, 6-chlorohexyl, 6-bromohexyl, 6-iodohexyl and dodecafluorohexyl;

$C_3$-$C_6$-alkenyl and also the $C_3$-$C_6$-alkenyl moieties of $C_3$-$C_6$-alkenyloxy-$C_1$-$C_6$-alkyl, $C_3$-$C_6$-alkenyloxy-$C_1$-$C_6$-alkoxy-$C_1$-$C_6$-alkyl, $C_3$-$C_6$-alkenyloxycarbonyl-$C_1$-$C_6$-alkyl: for example 1-propenyl, 2-propenyl, 1-methylethenyl, 1-butenyl, 2-butenyl, 3-butenyl, 1-methyl-1-propenyl, 2-methyl-1-propenyl, 1-methyl-2-propenyl, 2-methyl-2-propenyl, 1-pentenyl, 2-pentenyl, 3-pentenyl, 4-pentenyl, 1-methyl-1-butenyl, 2-methyl-1-butenyl, 3-methyl-1-butenyl, 1-methyl-2-butenyl, 2-methyl-2-butenyl, 3-methyl-2-butenyl, 1-methyl-3-butenyl, 2-methyl-3-butenyl, 3-methyl-3-butenyl, 1,1-dimethyl-2-propenyl, 1,2-dimethyl-1-propenyl, 1,2-dimethyl-2-propenyl, 1-ethyl-1-propenyl, 1-ethyl-2-propenyl, 1-hexenyl, 2-hexenyl, 3-hexenyl, 4-hexenyl, 5-hexenyl, 1-methyl-1-pentenyl, 2-methyl-1-pentenyl, 3-methyl-1-pentenyl, 4-methyl-1-pentenyl, 1-methyl-2-pentenyl, 2-methyl-2-pentenyl, 3-methyl-2-pentenyl, 4-methyl-2-pentenyl, 1-methyl-3-pentenyl, 2-methyl-3-pentenyl, 3-methyl-3-pentenyl, 4-methyl-3-pentenyl, 1-methyl-4-pentenyl, 2-methyl-4-pentenyl, 3-methyl-4-pentenyl, 4-methyl-4-pentenyl, 1,1-dimethyl-2-butenyl, 1,1-dimethyl-3-butenyl, 1,2-dimethyl-1-butenyl, 1,2-dimethyl-2-butenyl, 1,2-dimethyl-3-butenyl, 1,3-dimethyl-1-butenyl, 1,3-dimethyl-2-butenyl, 1,3-dimethyl-3-butenyl, 2,2-dimethyl-3-butenyl, 2,3-dimethyl-1-butenyl, 2,3-dimethyl-2-butenyl, 2,3-dimethyl-3-butenyl, 3,3-dimethyl-1-butenyl, 3,3-dimethyl-2-butenyl, 1-ethyl-1-butenyl, 1-ethyl-2-butenyl, 1-ethyl-3-butenyl, 2-ethyl-1-butenyl, 2-ethyl-2-butenyl, 2-ethyl-3-butenyl, 1,1,2-trimethyl-2-propenyl, 1-ethyl-1-methyl-2-propenyl, 1-ethyl-2-methyl-1-propenyl and 1-ethyl-2-methyl-2-propenyl;

$C_3$-$C_6$-haloalkenyl and also the $C_3$-$C_6$-haloalkenyl moieties of $C_3$-$C_6$-haloalkenyloxy-$C_1$-$C_6$-alkyl: a $C_3$-$C_6$-alkenyl radical as mentioned above which is partially or fully substituted by fluorine, chlorine, bromine and/or iodine, for example 2-chloroprop-2-en-1-yl, 3-chloroprop-2-en-1-yl, 2,3-dichloroprop-2-en-1-yl, 3,3-dichloroprop-2-en-1-yl, 2,3,3-trichloro-2-en-1-yl, 2,3-dichlorobut-2-en-1-yl, 2-bromoprop-2-en-1-yl, 3-bromoprop-2-en-1-yl, 2,3-dibromoprop-2-en-1-yl, 3,3-dibromoprop-2-en-1-yl, 2,3,3-tribromo-2-en-1-yl or 2,3-dibromobut-2-en-1-yl;

$C_3$-$C_6$-alkynyl and also the $C_3$-$C_6$-alkynyl moieties of $C_3$-$C_6$-alkynyloxycarbonyl-$C_1$-$C_6$-alkyl: for example 1-propynyl, 2-propynyl, 1-butynyl, 2-butynyl, 3-butynyl, 1-methyl-2-propynyl, 1-pentynyl, 2-pentynyl, 3-pentynyl, 4-pentynyl, 1-methyl-2-butynyl, 1-methyl-3-butynyl, 2-methyl-3-butynyl, 3-methyl-1-butynyl, 1,1-dimethyl-2-propynyl, 1-ethyl-2-propynyl, 1-hexynyl, 2-hexynyl, 3-hexynyl, 4-hexynyl, 5-hexynyl, 1-methyl-2-pentynyl, 1-methyl-3-pentynyl, 1-methyl-4-pentynyl, 2-methyl-3-pentynyl, 2-methyl-4-pentynyl, 3-methyl-1-pentynyl, 3-methyl-4-pentynyl, 4-methyl-1-pentynyl, 4-methyl-2-pentynyl, 1,1-dimethyl-2-butynyl, 1,1-dimethyl-3-butynyl, 1,2-dimethyl-3-butynyl, 2,2-dimethyl-3-butynyl, 3,3-dimethyl-1-butynyl, 1-ethyl-2-butynyl, 1-ethyl-3-butynyl, 2-ethyl-3-butynyl and 1-ethyl-1-methyl-2-propynyl;

$C_3$-$C_6$-haloalkynyl: a $C_3$-$C_6$-alkynyl radical as mentioned above which is partially or fully substituted by fluorine, chlorine, bromine and/or iodine, for example 1,1-difluoroprop-2-yn-1-yl, 3-chloroprop-2-yn-1-yl, 3-bromoprop-2-yn-1-yl, 3-iodoprop-2-yn-1-yl, 4-fluorobut-2-yn-1-yl, 4-chlorobut-2-yn-1-yl, 1,1-difluorobut-2-yn-1-yl, 4-iodobut-3-yn-1-yl, 5-fluoropent-3-yn-1-yl, 5-iodopent-4-yn-1-yl, 6-fluorohex-4-yn-1-yl or 6-iodohex-5-yn-1-yl;

$C_1$-$C_3$-alkoxy and also the $C_1$-$C_3$-alkoxy moieties of $C_1$-$C_3$-alkoxy-$C_1$-$C_3$-alkyl, $C_1$-$C_3$-alkoxycarbonyl: for example methoxy, ethoxy, propoxy;

$C_1$-$C_4$-alkoxy and also the $C_1$-$C_4$-alkoxy moieties of $C_1$-$C_4$-alkoxycarbonyl: for example methoxy, ethoxy, propoxy, 1-methylethoxy butoxy, 1-methylpropoxy, 2-methylpropoxy and 1,1-dimethylethoxy;

$C_1$-$C_6$-alkoxy and also the $C_1$-$C_6$-alkoxy moieties of $C_1$-$C_6$-alkyoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_3$-$C_6$-alkenyloxy-$C_1$-$C_6$-alkoxy-$C_1$-$C_6$-alkyl, $C_1$-$C_6$-alkoxycarbonyl-$C_1$-$C_6$-alkyl: $C_1$-$C_4$-alkoxy as mentioned above, and also, for example, pentoxy, 1-methylbutoxy, 2-methylbutoxy, 3-methoxybutoxy, 1,1-dimethylpropoxy, 1,2-dimethylpropoxy, 2,2-dimethylpropoxy, 1-ethylpropoxy, hexoxy, 1-methylpentoxy, 2-methylpentoxy, 3-methylpentoxy, 4-methylpentoxy, 1,1-dimethylbutoxy, 1,2-dimethylbutoxy, 1,3-dimethylbutoxy, 2,2-dimethylbutoxy, 2,3-dimethylbutoxy, 3,3-dimethylbutoxy, 1-ethylbutoxy, 2-ethylbutoxy, 1,1,2-trimethylpropoxy, 1,2,2-trimethylpropoxy, 1-ethyl-1-methylpropoxy and 1-ethyl-2-methylpropoxy.

$C_1$-$C_3$-haloalkoxy: a $C_1$-$C_3$-alkoxy radical as mentioned above which is partially or fully substituted by fluorine, chlorine, bromine and/or iodine, i.e., for example, fluoromethoxy, difluoromethoxy, trifluoromethoxy, chlorodifluoromethoxy, bromodifluoromethoxy, 2-fluoroethoxy, 2-chloroethoxy, 2-bromomethoxy, 2-iodoethoxy, 2,2-difluoroethoxy, 2,2,2-trifluoroethoxy, 2-chloro-2-fluoroethoxy, 2-chloro-2,2-difluoroethoxy, 2,2-dichloro-2-fluoroethoxy, 2,2,2-trichloroethoxy, pentafluoroethoxy, 2-fluoropropoxy, 3-fluoropropoxy, 2-chloropropoxy, 3-chloropropoxy, 2-bromopropoxy, 3-bromopropoxy, 2,2-difluoropropoxy, 2,3-difluoropropoxy, 2,3-dichloropropoxy, 3,3,3-trifluoropropoxy, 3,3,3-trichloropropoxy, 2,2,3,3,3-pentafluoropropoxy, heptafluoropropoxy, 1-(fluoromethyl)-2-fluoroethoxy, 1-(chloromethyl)-2-chloroethoxy, 1-(bromo-methyl)-2-bromoethoxy;

$C_1$-$C_4$-haloalkoxy: a $C_1$-$C_4$-alkoxy radical as mentioned above which is partially or fully substituted by fluorine, chlorine, bromine and/or iodine, i.e., for example, fluoromethoxy, difluoromethoxy, trifluoromethoxy, chlorodifluoromethoxy, bromodifluoromethoxy, 2-fluoroethoxy, 2-chloroethoxy, 2-bromomethoxy, 2-iodoethoxy, 2,2-difluoroethoxy, 2,2,2-trifluoroethoxy, 2-chloro-2-fluoroethoxy, 2-chloro-2,2-difluoroethoxy, 2,2-dichloro-2-fluoroethoxy, 2,2,2-trichloroethoxy, pentafluoroethoxy, 2-fluoropropoxy, 3-fluoropropoxy, 2-chloropropoxy, 3-chloropropoxy, 2-bromopropoxy, 3-bromopropoxy, 2,2-difluoropropoxy, 2,3-difluoropropoxy, 2,3-dichloropropoxy, 3,3,3-trifluoropropoxy, 3,3,3-trichloropropoxy, 2,2,3,3,3-pentafluoropropoxy, heptafluoropropoxy, 1-(fluoromethyl)-2-fluoroethoxy, 1-(chloromethyl)-2-chloroethoxy, 1-(bromo-methyl)-2-bromoethoxy, 4-fluorobutoxy, 4-chlorobutoxy, 4-bromobutoxy and nonafluorobutoxy;

$C_1$-$C_6$-haloalkoxy and also the $C_1$-$C_6$-haloalkoxy moieties of $C_1$-$C_6$-haloalkoxy-$C_1$-$C_6$-alkyl, $C_1$-$C_6$-haloalkoxycarbonyl-$C_1$-$C_6$-alkyl: a $C_1$-$C_4$-haloalkoxy as mentioned above, and also, for example, 5-fluoropentoxy, 5-chloropentoxy, 5-bromopentoxy, 5-iodopentoxy, undecafluoropentoxy, 6-fluorohexoxy, 6-chlorohexoxy, 6-bromohexoxy, 6-iodohexoxy and dodecafluorohexoxy;

$C_1$-$C_3$-alkylthio: for example methylthio, ethylthio, propylthio, 1-methylethylthio;

$C_1$-$C_4$-alkylthio: for example methylthio, ethylthio, propylthio, 1-methylethylthio, butylthio, 1-methylpropylthio, 2-methylpropylthio and 1,1-dimethylethylthio;

$C_1$-$C_6$-alkylthio and also the $C_1$-$C_6$-alkylthio moieties of $C_1$-$C_6$-alkylthio-$C_1$-$C_6$-alkyl: $C_1$-$C_4$-alkylthio as mentioned above, and also, for example, pentylthio, 1-methylbutylthio, 2-methylbutylthio, 3-methylbutylthio, 2,2-dimethylpropylthio, 1-ethylpropylthio, hexylthio, 1,1-dimethylpropylthio, 1,2-dimethylpropylthio, 1-methylpentylthio, 2-methylpentylthio, 3-methylpentylthio, 4-methylpentylthio, 1,1-dimethylbutylthio, 1,2-dimethylbutylthio, 1,3-dimethylbutylthio, 2,2-dimethylbutylthio, 2,3-dimethylbutylthio, 3,3-dimethylbutylthio, 1-ethylbutylthio, 2-ethylbutylthio, 1,1,2-trimethylpropylthio, 1,2,2-trimethylpropylthio, 1-ethyl-1-methylpropylthio and 1-ethyl-2-methylpropylthio;

$C_1$-$C_6$-alkylsulfinyl ($C_1$-$C_6$-alkyl-S(=O)—) and also the $C_1$-$C_6$-alkylsulfinyl moieties of $C_1$-$C_6$-alkylsulfinyl-$C_1$-$C_6$-alkyl: for example methylsulfinyl, ethylsulfinyl, propylsulfinyl, 1-methylethylsulfinyl, butylsulfinyl, 1-methylpropylsulfinyl, 2-methylpropylsulfinyl, 1,1-di-methylethylsulfinyl, pentylsulfinyl, 1-methylbutylsulfinyl, 2-methylbutylsulfinyl, 3-methylbutylsulfinyl, 2,2-dimethylpropylsulfinyl, 1-ethylpropylsulfinyl, 1,1-dimethylpropylsulfinyl, 1,2-dimethylpropylsulfinyl, hexylsulfinyl, 1-methylpentylsulfinyl, 2-methylpentylsulfinyl, 3-methylpentylsulfinyl, 4-methylpentylsulfinyl, 1,1-dimethylbutylsulfinyl, 1,2-dimethylbutylsulfinyl, 1,3-dimethylbutyl-sulfinyl, 2,2-dimethylbutylsulfinyl, 2,3-dimethylbutylsulfinyl, 3,3-dimethylbutyl-sulfinyl, 1-ethylbutylsulfinyl, 2-ethylbutylsulfinyl, 1,1,2-trimethylpropylsulfinyl, 1,2,2-trimethylpropylsulfinyl, 1-ethyl-1-methylpropylsulfinyl and 1-ethyl-2-methylpropylsulfinyl;

$C_1$-$C_6$-alkylsulfonyl ($C_1$-$C_6$-alkyl-S(O)$_2$—) and also the $C_1$-$C_6$-alkylsulfonyl moieties of $C_1$-$C_6$-alkylsulfonyl-$C_1$-$C_6$-alkyl: for example methylsulfonyl, ethylsulfonyl, propylsulfonyl, 1-methylethylsulfonyl, butylsulfonyl, 1-methylpropylsulfonyl, 2-methyl-propylsulfonyl, 1,1-dimethylethylsulfonyl, pentylsulfonyl, 1-methylbutylsulfonyl, 2-methylbutylsulfonyl, 3-methylbutylsulfonyl, 1,1-dimethylpropylsulfonyl, 1,2-dimethylpropylsulfonyl, 2,2-dimethylpropylsulfonyl, 1-ethylpropylsulfonyl, hexylsulfonyl, 1-methylpentylsulfonyl, 2-methylpentylsulfonyl, 3-methylpentylsulfonyl, 4-methylpentylsulfonyl, 1,1-dimethylbutylsulfonyl, 1,2-dimethylbutylsulfonyl, 1,3-dimethylbutylsulfonyl, 2,2-dimethylbutylsulfonyl, 2,3-dimethylbutylsulfonyl, 3,3-dimethylbutylsulfonyl, 1-ethylbutylsulfonyl, 2-ethylbutylsulfonyl, 1,1,2-trimethylpropylsulfonyl, 1,2,2-trimethylpropylsulfonyl, 1-ethyl-1-methylpropylsulfonyl and 1-ethyl-2-methylpropylsulfonyl;

($C_1$-$C_3$-alkyl)amino: for example methylamino, ethylamino, propylamino, 1-methylethyl-amino;

($C_1$-$C_4$-alkyl)amino: for example methylamino, ethylamino, propylamino, 1-methylethyl-amino, butylamino, 1-methylpropylamino, 2-methylpropylamino or 1,1-dimethylethylamino;

($C_1$-$C_6$-alkyl)amino: ($C_1$-$C_4$-alkylamino) as mentioned above, and also, for example, pentylamino, 1-methylbutylamino, 2-methylbutylamino, 3-methylbutylamino, 2,2-dimethylpropylamino, 1-ethylpropylamino, hexylamino, 1,1-dimethylpropylamino, 1,2-dimethylpropylamino, 1-methylpentylamino, 2-methylpentylamino, 3-methylpentylamino, 4-methylpentylamino, 1,1-dimethylbutylamino, 1,2-dimethylbutylamino, 1,3-dimethylbutylamino, 2,2-dimethylbutylamino, 2,3-dimethylbutyl-amino 3,3-dimethylbutylamino, 1-ethylbutylamino, 2-ethylbutylamino, 1,1,2-trimethylpropylamino, 1,2,2-trimethyl-propylamino, 1-ethyl-1-methylpropylamino or 1-ethyl-2-methylpropylamino;

di($C_1$-$C_6$-alkyl)amino: di($C_1$-$C_4$-alkyl)amino as mentioned above, and also, for example, N-methyl-N-pentylamino, N-methyl-N-(1-methylbutyl)amino, N-methyl-N-(2-methylbutyl)amino, N-methyl-N-(3-methylbutyl)amino, N-methyl-N-(2,2-dimethylpropyl)amino, N-methyl-N-(1-ethylpropyl)amino, N-methyl-N-hexylamino, N-methyl-N-(1,1-dimethylpropyl)

amino, N-methyl-N-(1,2-dimethylpropyl)amino, N-methyl-N-(1-methylpentyl)amino, N-methyl-N-(2-methylpentyl)amino, N-methyl-N-(3-methylpentyl) amino, N-methyl-N-(4-methylpentyl)amino, N-methyl-N-(1,1-dimethylbutyl)amino, N-methyl-N-(1,2-dimethylbutyl)amino, N-methyl-N-(1,3-dimethylbutyl)amino, N-methyl-N-(2,2-dimethylbutyl)amino, N-methyl-N-(2,3-dimethylbutyl)amino, N-methyl-N-(3,3-dimethylbutyl)amino, N-methyl-N-(1-ethylbutyl)amino, N-methyl-N-(2-ethylbutyl)amino, N-methyl-N-(1,1,2-trimethylpropyl)amino, N-methyl-N-(1,2,2-trimethylpropyl)amino, N-methyl-N-(1-ethyl-1-methylpropyl)amino, N-methyl-N-(1-ethyl-2-methylpropyl)amino, N-ethyl-N-pentylamino, N-ethyl-N-(1-methylbutyl)amino, N-ethyl-N-(2-methylbutyl) amino, N-ethyl-N-(3-methylbutyl)amino, N-ethyl-N-(2,2-dimethylpropyl)amino, N-ethyl-N-(1-ethylpropyl) amino, N-ethyl-N-hexylamino, N-ethyl-N-(1,1-dimethylpropyl)amino, N-ethyl-N-(1,2-dimethylpropyl)amino, N-ethyl-N-(1-methylpentyl) amino, N-ethyl-N-(2-methyl-pentyl)amino, N-ethyl-N-(3-methylpentyl)amino, N-ethyl-N-(4-methylpentyl) amino, N-ethyl-N-(1,1-dimethylbutyl)amino, N-ethyl-N-(1,2-dimethylbutyl)amino, N-ethyl-N-(1,3-dimethylbutyl)amino, N-ethyl-N-(2,2-dimethylbutyl) amino, N-ethyl-N-(2,3-dimethylbutyl)amino, N-ethyl-N-(3,3-dimethylbutyl)amino, N-ethyl-N-(1-ethylbutyl) amino, N-ethyl-N-(2-ethylbutyl)amino, N-ethyl-N-(1,1,2-trimethylpropyl)amino, N-ethyl-N-(1,2,2-trimethylpropyl)amino, N-ethyl-N-(1-ethyl-1-methylpropyl)amino, N-ethyl-N-(1-ethyl-2-methylpropyl)amino, N-propyl-N-pentylamino, N-butyl-N-pentylamino, N,N-dipentylamino, N-propyl-N-hexylamino, N-butyl-N-hexylamino, N-pentyl-N-hexylamino or N,N-dihexylamino;

$C_3$-$C_6$-cycloalkyl and also the cycloalkyl moieties of $C_3$-$C_6$-cycloalkyl-$C_1$-$C_6$-alkyl: monocyclic saturated hydrocarbons having 3 to 6 ring members, such as cyclopropyl, cyclobutyl, cyclopentyl and cyclohexyl;

$C_3$-$C_6$-heterocyclyl and also the heterocyclyl moieties of $C_3$-$C_6$-heterocyclyl-$C_1$-$C_6$-alkyl: aliphatic heterocycle having 3 to 6 ring members which, in addition to carbon atoms, contains 1 to 4 nitrogen atoms, or 1 to 3 nitrogen atoms and an oxygen or sulphur atom, or an oxygen or a sulphur atom, for example three- or four-membered heterocycles like 2-oxetanyl, 3-oxetanyl, 2-thietanyl, 3-thietanyl, 1-azetidinyl, 2-azetidinyl, 1-azetinyl, 2-azetinyl; five-membered saturated heterocycles like 2-tetrahydrofuranyl, 3-tetrahydrofuranyl, 2-tetrahydrothienyl, 3-tetrahydrothienyl, 1-pyrrolidinyl, 2-pyrrolidinyl, 3-pyrrolidinyl, 3-isoxazolidinyl, 4-isoxazolidinyl, 5-isoxazolidinyl, 2-isothiazolidinyl, 3-isothiazolidinyl, 4-isothiazolidinyl, 5-isothiazolidinyl, 1-pyrazolidinyl, 3-pyrazolidinyl, 4-pyrazolidinyl, 5-pyrazolidinyl, 2-oxazolidinyl, 4-oxazolidinyl, 5-oxazolidinyl, 2-thiazolidinyl, 4-thiazolidinyl, 5-thiazolidinyl, 1-imidazolidinyl, 2-imidazolidinyl, 4-imidazolidinyl, 3-oxazolidinyl, 1,2,4-oxadiazolidin-3-yl, 1,2,4-oxadiazolidin-5-yl, 3-thiazolidinyl, 1,2,4-thiadiazolidin-3-yl, 1,2,4-thiadiazolidin-5-yl, 1,2,4-triazolidin-3-yl, 1,2,4-oxadiazolidin-2-yl, 1,2,4-oxadiazolidin-4-yl, 1,3,4-oxadiazolidin-2-yl, 1,2,4-thiadiazolidin-2-yl, 1,2,4-thiadiazolidin-4-yl, 1,3,4-thiadiazolidin-2-yl, 1,2,4-triazolidin-1-yl, 1,3,4-triazolidin-2-yl; six-membered saturated heterocycles like 1-piperidinyl, 2-piperidinyl, 3-piperidinyl, 4-piperidinyl, 1,3-dioxan-5-yl, 1,4-dioxanyl, 1,3-dithian-5-yl, 1,3-dithianyl, 1,3-oxathian-5-yl, 1,4-oxathianyl, 2-tetrahydropyranyl, 3-tetrahydopyranyl, 4-tetrahydropyranyl, 2-tetrahydrothiopyranyl, 3-tetrahydrothiopyranyl, 4-tetrahydrothiopyranyl, 1-hexahydropyridazinyl, 3-hexahydropyridazinyl, 4-hexahydropyridazinyl, 1-hexahydropyrimidinyl, 2-hexahydropyrimidinyl, 4-hexahydropyrimidinyl, 5-hexahydropyrimidinyl, 1-piperazinyl, 2-piperazinyl, 1,3,5-hexahydrotriazin-1-yl, 1,3,5-hexahydrotriazin-2-yl, 1,2,4-hexahydrotriazin-1-yl, 1,2,4-hexahydrotriazin-3-yl, tetrahydro-1,3-oxazin-1-yl, tetrahydro-1,3-oxazin-2-yl, tetrahydro-1,3-oxazin-6-yl, 1-morpholinyl, 2-morpholinyl, 3-morpholinyl;

5- or 6 membered heteroaryl: aromatic heteroaryl having 5 or 6 ring members which, in addition to carbon atoms, contains 1 to 4 nitrogen atoms, or 1 to 3 nitrogen atoms and an oxygen or sulphur atom, or an oxygen or a sulphur atom, for example 5-membered aromatic rings like furyl (for example 2-furyl, 3-furyl), thienyl (for example 2-thienyl, 3-thienyl), pyrrolyl (for example pyrrol-2-yl, pyrrol-3-yl), pyrazolyl (for example pyrazol-3-yl, pyrazol-4-yl), isoxazolyl (for example isoxazol-3-yl, isoxazol-4-yl, isoxazol-5-yl), isothiazolyl (for example isothiazol-3-yl, isothiazol-4-yl, isothiazol-5-yl), imidazolyl (for example imidazole-2-yl, imidazole-4-yl), oxazolyl (for example oxazol-2-yl, oxazol-4-yl, oxazol-5-yl), thiazolyl (for example thiazol-2-yl, thiazol-4-yl, thiazol-5-yl), oxadiazolyl (for example 1,2,3-oxadiazol-4-yl, 1,2,3-oxadiazol-5-yl, 1,2,4-oxadiazol-3-yl, 1,2,4-oxadiazol-5-yl, 1,3,4-oxadiazol-2-yl), thiadiazolyl (for example 1,2,3-thiadiazol-4-yl, 1,2,3-thiadiazol-5-yl, 1,2,4-thiadiazol-3-yl, 1,2,4-thiadiazol-5-yl, 1,3,4-thiadiazolyl-2-yl), triazolyl (for example 1,2,3-triazol-4-yl, 1,2,4-triazol-3-yl); 1-tetrazolyl; 6-membered aromatic rings like pyridyl (for example pyridine-2-yl, pyridine-3-yl, pyridine-4-yl), pyrazinyl (for example pyridazin-3-yl, pyridazin-4-yl), pyrimidinyl (for example pyrimidin-2-yl, pyrimidin-4-yl, pyrimidin-5-yl), pyrazin-2-yl, triazinyl (for example 1,3,5-triazin-2-yl, 1,2,4-triazin-3-yl, 1,2,4-triazin-5-yl, 1,2,4-triazin-6-yl);

3- to 7-membered carbocyclus: a three- to seven-membered monocyclic, saturated, partial unsaturated or aromatic cycle having three to seven ring members which comprises apart from carbon atoms optionally one or two ring members selected from the group consisting of —N($R^{12}$)—, —N=N—, —C(=O)—, —O— and —S—.

The preferred embodiments of the invention mentioned herein below have to be understood as being preferred either independently from each other or in combination with one another.

According to a preferred embodiment of the invention preference is also given to those uracilpyridines of formula (I), wherein the variables, either independently of one another or in combination with one another, have the following meanings:

Preferred are the uracilpyridines of formula (I) wherein
$R^1$ is hydrogen, $NH_2$ or $C_1$-$C_6$-alkyl;
preferably is $NH_2$ or $C_1$-$C_4$-alkyl;
particularly preferred is $NH_2$ or $CH_3$;
also preferably is $C_1$-$C_6$-alkyl;
particularly preferred is $C_1$-$C_4$-alkyl;
especially preferred is $CH_3$.

Also preferred are the uracilpyridines of formula (I) wherein
$R^2$ is $C_1$-$C_6$-alkyl or $C_1$-$C_6$-haloalkyl;
preferably is $C_1$-$C_4$-alkyl or $C_1$-$C_4$-haloalkyl;
more preferred is $C_1$-$C_4$-haloalkyl;

particularly preferred is $C_1-C_2$-haloalkyl;
especially preferred is $CF_3$.

Also preferred are the uracilpyridines of formula (I) wherein
$R^3$ is H;
also preferably is $C_1-C_6$-alkyl,
particularly preferred is $C_1-C_4$-alkyl,
especially preferred is $CH_3$.

Also preferred are the uracilpyridines of formula (I) wherein
$R^4$ is H, F or Cl;
particularly preferred is H or F;
especially preferred is H;
also particularly preferred is H or Cl;
especially preferred is Cl;
also particularly preferred is F or Cl;
especially preferred is F.

Also preferred are the uracilpyridines of formula (I) wherein
$R^5$ is halogen or CN;
preferably F, Cl, Br or CN;
particularly preferred is F, Cl or CN;
especially preferred is Cl or CN;
more preferred is Cl;
also more preferred is CN;
also especially preferred is F or Cl;
more preferred is F.

Also preferred are the uracilpyridines of formula (I) wherein
$R^6$ is H, $C_1-C_3$-alkyl, $C_1-C_3$-haloalkyl, $C_1-C_3$-alkoxy, $C_1-C_3$-haloalkoxy or $C_1-C_3$-alkylthio;
particularly preferred is H, $C_1-C_3$-alkyl, $C_1-C_3$-haloalkyl or $C_1-C_3$-alkoxy;
especially preferred is H, $C_1-C_3$-alkyl or $C_1-C_3$-alkoxy;
more preferred is H, $CH_3$ or $OCH_3$.

Also preferred are the uracilpyridines of formula (I) wherein
$R^7$ is H, halogen or $C_1-C_3$-alkyl;
particularly preferred is H, F or $CH_3$;
especially preferred is H.

Also preferred are the uracilpyridines of formula (I) wherein
$R^8$ is $OR^9$, $SR^9$, $NR^{10}R^{11}$, $NR^9S(O)_2R^{10}$ or $NR^9S(O)_2NR^{10}R^{11}$;
particularly preferred is $OR^9$, $NR^{10}R^{11}$, $NR^9S(O)_2R^{10}$ or $NR^9S(O)_2NR^{10}R^{11}$;
especially preferred $OR^9$, $NR^9S(O)_2R^{10}$ or $NR^9S(O)_2NR^{10}R^{11}$;
especially preferred is $OR^9$ or $NR^9S(O)_2R^{10}$.

Also preferred are the uracilpyridines of formula (I) wherein
$R^9$ is hydrogen, $C_1-C_6$-alkyl, $C_3-C_6$-alkenyl, $C_3-C_6$-alkynyl, $C_1-C_6$-haloalkyl, $C_3-C_6$-haloalkenyl, $C_3-C_6$-haloalkynyl, $C_1-C_6$-cyanoalkyl, $C_1-C_6$-alkoxy-$C_1-C_6$-alkyl, $C_1-C_6$-alkoxy-$C_1-C_6$-alkoxy-$C_1-C_6$-alkyl, di($C_1-C_6$-alkoxy)$C_1-C_6$-alkyl, $C_1-C_6$-haloalkoxy-$C_1-C_6$-alkyl, $C_3-C_6$-alkenyloxy-$C_1-C_6$-alkyl, $C_3-C_6$-haloalkenyloxy-$C_1-C_6$-alkyl, $C_3-C_6$-alkenyloxy-$C_1-C_6$-alkoxy-$C_1-C_6$-alkyl, $C_1-C_6$-alkylthio-$C_1-C_6$-alkyl, $C_1-C_6$-alkylsulfinyl-$C_1-C_6$-alkyl, $C_1-C_6$-alkylsulfonyl-$C_1-C_6$-alkyl, $C_1-C_6$-alkylcarbonyl-$C_1-C_6$-alkyl, $C_1-C_6$-alkoxycarbonyl-$C_1-C_6$-alkyl, $C_1-C_6$-haloalkoxy-carbonyl-$C_1-C_6$-alkyl, $C_3-C_6$-alkenyloxycarbonyl-$C_1-C_6$-alkyl, $C_3-C_6$-alkynyloxycarbonyl-$C_1-C_6$-alkyl, amino, ($C_1-C_6$-alkyl)amino, di($C_1-C_6$-alkyl)amino, ($C_1-C_6$-alkylcarbonyl)amino, amino-$C_1-C_6$-alkyl, ($C_1-C_6$-alkyl)amino-$C_1-C_6$-alkyl, di($C_1-C_6$-alkyl)amino-$C_1-C_6$-alkyl, aminocarbonyl-$C_1-C_6$-alkyl, ($C_1-C_6$-alkyl)aminocarbonyl-$C_1-C_6$-alkyl, di($C_1-C_6$-alkyl)aminocarbonyl-$C_1-C_6$-alkyl, $N=CR^{12}R^{13}$ wherein $R^{12}$ and $R^{13}$ independently of one another are H, $C_1-C_4$-alkyl or phenyl; $C_3-C_6$-cycloalkyl, $C_3-C_6$-cycloalkyl-$C_1-C_6$-alkyl, $C_3-C_6$-heterocyclyl, phenyl, phenyl-$C_1-C_4$-alkyl or a 5- or 6-membered heteroaryl, wherein each cycloalkyl, heterocyclyl, phenyl or heteroaryl ring can be substituted
by one to four substituents selected from $R^{14}$ or a 3- to 7-membered carbocyclus, which carbocyclus optionally has in addition to carbon atoms one or two ring members selected from the group consisting of $-N(R^{12})-$, $-N=N-$, $-C(=O)-$, $-O-$ and $-S-$, and
which carbocyclus is optionally substituted with one to four substituents selected from $R^{14}$
wherein $R^{14}$ is halogen, $NO_2$, CN, $C_1-C_4$-alkyl, $C_1-C_4$-haloalkyl, $C_1-C_4$-alkoxy or $C_1-C_4$-alkoxycarbonyl;
preferably is hydrogen, $C_1-C_6$-alkyl, $C_3-C_6$-alkenyl, $C_3-C_6$-alkynyl, $C_1-C_6$-haloalkyl, $C_1-C_6$-alkoxy-$C_1-C_6$-alkyl, di($C_1-C_6$-alkoxy)$C_1-C_6$-alkyl, $C_1-C_6$-alkylcarbonyl-$C_1-C_6$-alkyl, $C_1-C_6$-alkoxycarbonyl-$C_1-C_6$-alkyl or $C_3-C_6$-cycloalkyl-$C_1-C_6$-alkyl;
particularly preferred is hydrogen, $C_1-C_6$-alkyl, $C_3-C_6$-alkenyl, $C_3-C_6$-alkynyl or $C_1-C_6$-haloalkyl;
also particularly preferred is hydrogen, $C_1-C_6$-alkyl, $C_3-C_6$-alkenyl or $C_3-C_6$-alkynyl;
especially preferred is hydrogen, $C_1-C_6$-alkyl, or $C_3-C_6$-alkynyl;
more preferred is hydrogen, $CH_3$, $C_2H_5$, $CH_2CH=CH_2$ or $CH_2C=CH$;
most preferred is hydrogen, $CH_3$, $C_2H_5$ or $CH_2C=CH$.

Also preferred are the uracilpyridines of formula (I) wherein
$R^{10}$ is H, $C_1-C_6$-alkyl or $C_3-C_6$-cycloalkyl;
particularly preferred is H or $C_1-C_6$-alkyl;
more preferred is H;
also more preferred is $C_1-C_6$-alkyl.

Also preferred are the uracilpyridines of formula (I) wherein
$R^{11}$ is H, $C_1-C_6$-alkyl or $C_1-C_6$-alkoxycarbonyl-$C_1-C_6$-alkyl;
particularly preferred is H or $C_1-C_6$-alkyl;
more preferred is H;
also more preferred is $C_1-C_6$-alkyl.

Also preferred are the uracilpyridines of formula (I) wherein
$R^{12}$ is phenyl or $C_1-C_4$-alkyl;
particularly preferred is phenyl or $CH_3$;
also particularly preferred is phenyl;
also particularly preferred is $C_1-C_4$-alkyl.

Also preferred are the uracilpyridines of formula (I) wherein
$R^{13}$ is phenyl or $C_1-C_4$-alkyl;
particularly preferred is phenyl or $CH_3$;
also particularly preferred is phenyl;
also particularly preferred is $C_1-C_4$-alkyl.

Also preferred are the uracilpyridines of formula (I) wherein
$R^{14}$ is halogen or $C_1-C_6$-alkyl;
particularly preferred is F, Cl or $CH_3$;
also particularly preferred is halogen;
especially preferred is F or $Cl$;

also particularly preferred is $C_1$-$C_6$-alkyl;

especially preferred is $CH_3$.

Also preferred are the uracilpyridines of formula (I) wherein n is 1 or 2;

particularly preferred is 2;

also particularly preferred is 1.

Also preferred are the uracilpyridines of formula (I) wherein

Q is O, S, SO, $SO_2$, NH or ($C_1$-$C_3$-alkyl)N;

preferably is O or S;

particularly preferred is O.

Also preferred are the uracilpyridines of formula (I) wherein

W is O, also preferably is S.

Also preferred are the uracilpyridines of formula (I) wherein

X is O, also preferably is S.

Also preferred are the uracilpyridines of formula (I) wherein

Y is O, also preferably is S.

Also preferred are the uracilpyridines of formula (I) wherein

Z is phenyl or pyridyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy and $C_1$-$C_6$-haloalkoxy;

preferably is phenyl, which is optionally substituted by 1 to 4 substituents selected from the group consisting of halogen, CN, $C_1$-$C_6$-alkyl, $C_1$-$C_6$-haloalkyl, $C_1$-$C_6$-alkoxy and $C_1$-$C_6$-haloalkoxy;

also preferably is pyridyl, which is optionally substituted by 1 to 4 substituents selected from the group consisting of halogen, CN, $C_1$-$C_6$-alkyl, $C_1$-$C_6$-haloalkyl, $C_1$-$C_6$-alkoxy and $C_1$-$C_6$-haloalkoxy.

Also preferred are the uracilpyridines of formula (I) wherein

Z is phenyl or pyridyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy and $C_1$-$C_6$-haloalkoxy;

preferably is phenyl or pyridyl, each of which is optionally substituted by 1 to 4 substituents selected from the group consisting of halogen, $C_1$-$C_6$-alkyl, $C_1$-$C_6$-haloalkyl, $C_1$-$C_6$-alkoxy or $C_1$-$C_6$-haloalkoxy;

particularly preferred is phenyl or pyridyl, each of which is optionally substituted by 1 to 4 substituents selected from the group consisting of halogen or $C_1$-$C_6$-alkyl;

especially preferred is phenyl or pyridyl, each of which is optionally substituted by 1 to 4 substituents selected from the group consisting of F, Cl or $CH_3$;

more preferred is phenyl or pyridyl, each of which is unsubstituted.

Also preferred are the uracilpyridines of formula (I) wherein

Z is phenyl, which is optionally substituted by 1 to 4 substituents selected from the group consisting of halogen, CN, $C_1$-$C_6$-alkyl, $C_1$-$C_6$-haloalkyl, $C_1$-$C_6$-alkoxy and $C_1$-$C_6$-haloalkoxy;

preferably is phenyl, which is optionally substituted by 1 to 4 substituents selected from the group consisting of halogen, $C_1$-$C_6$-alkyl, $C_1$-$C_6$-haloalkyl, $C_1$-$C_6$-alkoxy or $C_1$-$C_6$-haloalkoxy;

particularly preferred is phenyl, which is optionally substituted by 1 to 4 substituents selected from the group consisting of halogen or $C_1$-$C_6$-alkyl;

especially preferred is phenyl which is optionally substituted by 1 to 4 substituents selected from the group consisting of F, $C_1$ or $CH_3$;

more preferred is unsubstituted phenyl.

Also preferred are the uracilpyridines of formula (I) wherein

Z is pyridyl, which is optionally substituted by 1 to 3 substituents selected from the group consisting of halogen, CN, $C_1$-$C_6$-alkyl, $C_1$-$C_6$-haloalkyl, $C_1$-$C_6$-alkoxy and $C_1$-$C_6$-haloalkoxy;

preferably is pyridyl, which is optionally substituted by 1 to 3 substituents selected from the group consisting of halogen, $C_1$-$C_6$-alkyl, $C_1$-$C_6$-haloalkyl, $C_1$-$C_6$-alkoxy or $C_1$-$C_6$-haloalkoxy;

particularly preferred is pyridyl, which is optionally substituted by 1 to 3 substituents selected from the group consisting of halogen or $C_1$-$C_6$-alkyl;

especially preferred is pyridyl, which is optionally substituted by 1 to 3 substituents selected from the group consisting of F, $C_1$ or $CH_3$;

more preferred is unsubstituted pyridyl.

Also preferred are the uracilpyridines of formula (I) wherein

Z is selected from the group consisting of $Z^1$ to $Z^{29}$

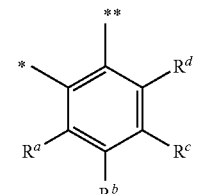

Z-1

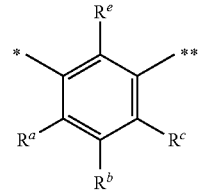

Z-2

-continued
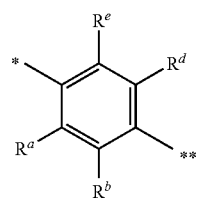 Z-3
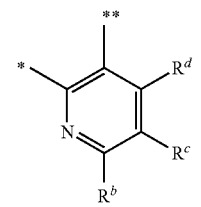 Z-4
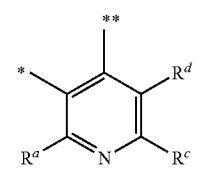 Z-5
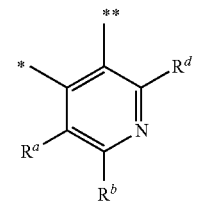 Z-6
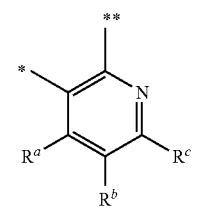 Z-7
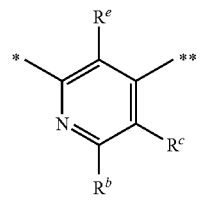 Z-8
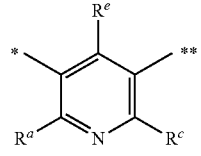 Z-9
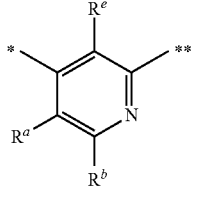 Z-10
-continued
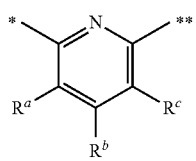 Z-11
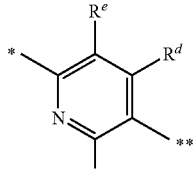 Z-12
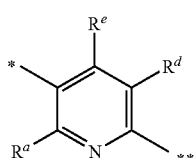 Z-13
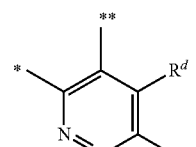 Z-14
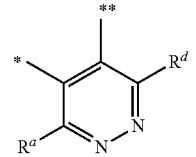 Z-15
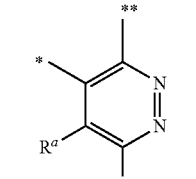 Z-16
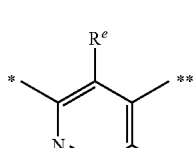 Z-17
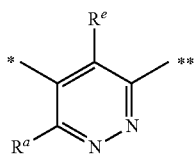 Z-18
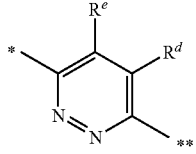 Z-19

-continued

Z-20
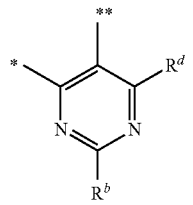

Z-21
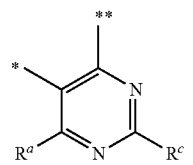

Z-22
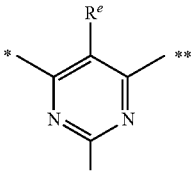

Z-23
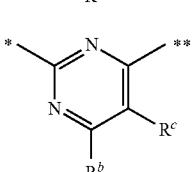

Z-24
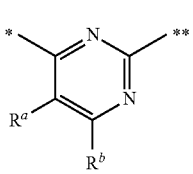

Z-25
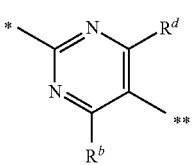

Z-26
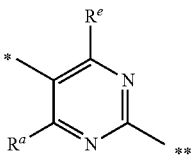

Z-27
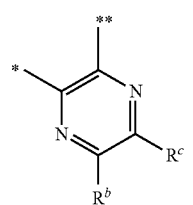

Z-28
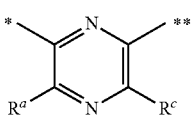

-continued

Z-29
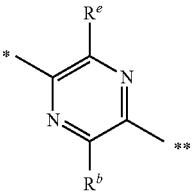

wherein
* denotes the point of attachment of Z to X;
** denotes the point of attachment of Z to Q; and
$R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy;
preferably H, halogen, $C_1$-$C_6$-alkyl, $C_1$-$C_6$-haloalkyl, $C_1$-$C_6$-alkoxy or $C_1$-$C_6$-haloalkoxy;
particularly preferred H, halogen or $C_1$-$C_6$-alkyl;
especially preferred H, F, C, or $CH_3$;
more preferred H.

Also preferred are the uracilpyridines of formula (I) wherein
Z is selected from the group consisting of $Z^1$, $Z^2$, $Z^3$, $Z^4$, $Z^5$, $Z^6$, $Z^7$, $Z^8$, $Z^9$, $Z^1$, $Z^{11}$, $Z^{12}$, $Z^{13}$ and $Z^{21}$ as defined above;
particularly preferred is selected from the group consisting of $Z^1$, $Z^2$, $Z^4$, $Z^5$, $Z^6$, $Z^7$, $Z^8$, $Z^9$, $Z^{10}$, $Z^{11}$ and $Z^{21}$ as defined above;
more particularly preferred is selected from the group consisting of $Z^1$, $Z^4$, $Z^5$, $Z^6$, $Z^7$ and $Z^{21}$ as defined above;
especially preferred is selected from the group consisting of $Z^1$, $Z^4$, $Z^5$, $Z^6$ and $Z^7$ as defined above;
more preferred is selected from the group consisting of $Z^1$ and $Z^7$ as defined above.

Also preferred are the uracilpyridines of formula (I) wherein
Z is selected from the group consisting of $Z^1$, $Z^2$, $Z^3$, $Z^4$, $Z^5$, $Z^6$, $Z^7$, $Z^8$, $Z^9$, $Z^{10}$, $Z^{11}$, $Z^{12}$, $Z^{13}$ and $Z^{21}$ as defined above; wherein
$R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy; preferably H, halogen, $C_1$-$C_6$-alkyl, $C_1$-$C_6$-haloalkyl, $C_1$-$C_6$-alkoxy or $C_1$-$C_6$-haloalkoxy;
particularly preferred H, halogen or $C_1$-$C_6$-alkyl;
especially preferred H, F, C, or $CH_3$;
more preferred H;
particularly preferred is selected from the group consisting of $Z^1$, $Z^2$, $Z^4$, $Z^5$, $Z^6$, $Z^7$, $Z^8$, $Z^9$, $Z^{10}$, $Z^{11}$ and $Z^{21}$ as defined above, wherein $R^a$, $R^b$, $R^c$, $R^d$ and $R^e$ independently of one another are
H, halogen, CN, $C_1$-$C_6$-alkyl, $C_1$-$C_6$-haloalkyl, $C_1$-$C_6$-alkoxy, $C_1$-$C_6$-haloalkoxy; preferably H, halogen, $C_1$-$C_6$-alkyl, $C_1$-$C_6$-haloalkyl, $C_1$-$C_6$-alkoxy or $C_1$-$C_6$-haloalkoxy;
particularly preferred H, halogen or $C_1$-$C_6$-alkyl;
especially preferred H, F, C, or $CH_3$;
more preferred H;
more particularly preferred is selected from the group consisting of $Z^1$, $Z^4$, $Z^5$, $Z^6$, $Z^7$, and $Z^{21}$ as defined above, wherein
$R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy; preferably H, halogen, $C_1$-$C_6$-alkyl, $C_1$-$C_6$-haloalkyl, $C_1$-$C_6$-alkoxy or $C_1$-$C_6$-haloalkoxy;
  particularly preferred H, halogen or $C_1$-$C_6$-alkyl;
  especially preferred H, F, C, or $CH_3$;
  more preferred H;
especially preferred is selected from the group consisting of $Z^1$, $Z^4$, $Z^5$, $Z^6$ and $Z^7$ as defined above, wherein
  $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy; preferably H, halogen, $C_1$-$C_6$-alkyl, $C_1$-$C_6$-haloalkyl, $C_1$-$C_6$-alkoxy or $C_1$-$C_6$-haloalkoxy;
  particularly preferred H, halogen or $C_1$-$C_6$-alkyl;
  especially preferred H, F, Cl, or $CH_3$;
  more preferred H;
more preferred is selected from the group consisting of $Z^1$ and $Z^7$ as defined above, wherein
  $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy; preferably H, halogen, $C_1$-$C_6$-alkyl, $C_1$-$C_6$-haloalkyl, $C_1$-$C_6$-alkoxy or $C_1$-$C_6$-haloalkoxy;
  particularly preferred H, halogen or $C_1$-$C_6$-alkyl;
  especially preferred H, F, C, or $CH_3$;
  more preferred H.
Also preferred are the uracilpyridines of formula (I) wherein
  $R^1$ is $C_1$-$C_6$-alkyl,
  $R^2$ is $C_1$-$C_4$-haloalkyl,
  $R^3$ is H, and
  Y is O.
Also preferred are the uracilpyridines of formula (I) wherein
  $R^4$ is H or F, and
  $R^5$ is F, Cl, Br or CN.
Also preferred are the uracilpyridines of formula (I) wherein
  $R^4$ is H or F, and
  $R^5$ is F, Cl or CN.
Also preferred are the uracilpyridines of formula (I) wherein
  $R^6$ is H, $C_1$-$C_3$-alkyl or $C_1$-$C_3$-alkoxy, and
  $R^7$ is H.
Also preferred are the uracilpyridines of formula (I) wherein
  $R^8$ is $OR^9$, $NR^9S(O)_2R^{10}$ or $NR^9S(O)_2NR^{10}R^{11}$, wherein
    $R^9$ is hydrogen, $C_1$-$C_6$-alkyl, $C_3$-$C_6$-alkenyl, $C_3$-$C_6$-alkynyl, $C_1$-$C_6$-haloalkyl, $C_1$-$C_6$-alkoxy-$C_1$-$C_6$-alkyl, di($C_1$-$C_6$-alkoxy)$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl or $C_3$-$C_6$-cycloalkyl-$C_1$-$C_6$-alkyl; and
    $R^{10}$, $R^{11}$ are $C_1$-$C_6$-alkyl.
Also preferred are the uracilpyridines of formula (I) wherein
  n is 1.
Also preferred are the uracilpyridines of formula (I) wherein
  Q, W and X are O.
Also preferred are the uracilpyridines of formula (I) wherein
  $R^1$ is hydrogen, $NH_2$ or $C_1$-$C_6$-alkyl;
  $R^2$ is $C_1$-$C_6$-alkyl or $C_1$-$C_6$-haloalkyl;
  $R^3$ is H;
  $R^4$ is H or halogen;
  $R^5$ is halogen or CN;
  $R^6$ is H, $C_1$-$C_3$-alkyl, $C_1$-$C_3$-haloalkyl, $C_1$-$C_3$-alkoxy, $C_1$-$C_3$-haloalkoxy or $C_1$-$C_3$-alkylthio;
  $R^7$ is H;
  $R^8$ is $OR^9$, $SR^9$, $NR^{10}R^{11}$, $NR^9S(O)_2R^{10}$ or $NR^9S(O)_2NR^{10}R^{11}$; wherein
    $R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_1$-$C_6$-haloalkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)amino-carbonyl-$C_1$-$C_6$-alkyl, di($C_1$-$C_6$-alkyl)aminocarbonyl-$C_1$-$C_6$-alkyl, —N=$CR^{12}R^{13}$
      wherein $R^{12}$ and $R^{13}$ independently of one another are H, $C_1$-$C_4$-alkyl or phenyl;
    $C_3$-$C_6$-cycloalkyl, $C_3$-$C_6$-cycloalkyl-$C_1$-$C_6$-alkyl, $C_3$-$C_6$-heterocyclyl, phenyl, phenyl-$C_1$-$C_4$-alkyl or a 5- or 6 membered heteroaryl,
      wherein each cycloalkyl, heterocyclyl, phenyl or heteroaryl ring can be substituted by one to four substituents selected from $R^{14}$ or a 3- to 7-membered carbocyclus,
      which carbocyclus optionally has in addition to carbon atoms one or two ring members selected from the group consisting of —N($R^{12}$)—, —N=N—, —C(=O)—, —O— and —S—, and
      which carbocyclus is optionally substituted with one to four substituents selected from $R^{14}$;
  $R^{10}$ is $C_1$-$C_6$-alkyl;
  $R^{11}$ is H or $C_1$-$C_6$-alkyl;
  $R^{12}$ is phenyl or $CH_3$;
  $R^{13}$ is phenyl or $CH_3$;
  $R^{14}$ is halogen or $C_1$-$C_6$-alkyl;
  n is 1 or 2;
  Q is O, S, SO, $SO_2$, NH or ($C_1$-$C_3$-alkyl)N;
  W is O;
  X is O;
  Y is O;
  Z $Z^1$, $Z^2$, $Z^3$, $Z^4$, $Z^5$, $Z^6$, $Z^7$, $Z^8$, $Z^9$, $Z^{10}$, $Z^{11}$, $Z^{12}$, $Z^{13}$ and $Z^{21}$ as defined above, wherein
    $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy;
particularly preferred are the uracilpyridines of formula (I) wherein
  $R^1$ is $NH_2$ or $C_1$-$C_4$-alkyl;
  $R^2$ is $C_1$-$C_4$-alkyl or $C_1$-$C_4$-haloalkyl;
  $R^3$ is H;
  $R^4$ is H or halogen;
  $R^5$ is halogen or CN;
  $R^6$ is H, $C_1$-$C_3$-alkyl, $C_1$-$C_3$-haloalkyl or $C_1$-$C_3$-alkoxy;
  $R^7$ is H;
  $R^8$ $OR^9$, $NR^{10}R^{11}$, $NR^9S(O)_2R^{10}$ or $NR^9S(O)_2NR^{10}R^{11}$; wherein $R^9$ is hydrogen, $C_1$-$C_6$-alkyl, $C_3$-$C_6$-alkenyl, $C_3$-$C_6$-alkynyl, $C_1$-$C_6$-haloalkyl, $C_1$-$C_6$-alkoxy-$C_1$-$C_6$-alkyl, di($C_1$-$C_6$-alkoxy)$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl or $C_3$-$C_6$-cycloalkyl-$C_1$-$C_6$-alkyl;

$R^{10}$ is $C_1$-$C_6$-alkyl;

$R^{11}$ is H or $C_1$-$C_6$-alkyl;

n is 1;

Q is O, S, SO, $SO_2$, NH or ($C_1$-$C_3$-alkyl)N;

W is O;

X is O;

Y is O;

Z is selected from the group consisting of $Z^1$, $Z^2$, $Z^4$, $Z^5$, $Z^6$, $Z^7$, $Z^8$, $Z^9$, $Z^{10}$, $Z^{11}$ and $Z^{21}$ as defined above, wherein $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy;

especially preferred are the uracilpyridines of formula (I) wherein $R^1$ is $NH_2$ or $CH_3$;

$R^2$ is $C_1$-$C_4$-haloalkyl;

$R^3$ is H;

$R^4$ is H, F or Cl;

$R^5$ is F, Cl, Br or CN;

$R^6$ is H, $C_1$-$C_3$-alkyl or $C_1$-$C_3$-alkoxy;

$R^7$ is H;

$R^8$ is $OR^9$ or $NR^9S(O)_2R^{10}$, wherein $R^9$ is hydrogen, $C_1$-$C_6$-alkyl, $C_3$-$C_6$-alkenyl, $C_3$-$C_6$-alkynyl or $C_1$-$C_6$-haloalkyl, and $R^{10}$ is $C_1$-$C_6$-alkyl;

n is 1;

Q is O or S;

W is O;

X is O;

Y is O;

Z is selected from the group consisting of $Z^1$, $Z^4$, $Z^5$, $Z^6$, $Z^7$ and $Z^{21}$ as defined above, wherein $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy;

also especially preferred are the uracilpyridines of formula (I) wherein $R^1$ is $NH_2$ or $CH_3$;

$R^2$ is $C_1$-$C_4$-haloalkyl;

$R^3$ is H;

$R^4$ is H, F or Cl;

$R^5$ is F, Cl or CN;

$R^6$ is H, $C_1$-$C_3$-alkyl or $C_1$-$C_3$-alkoxy;

$R^7$ is H;

$R^8$ is $OR^9$ or $NR^9S(O)_2R^{10}$, wherein $R^9$ is hydrogen, $C_1$-$C_6$-alkyl, $C_3$-$C_6$-alkenyl, $C_3$-$C_6$-alkynyl or $C_1$-$C_6$-haloalkyl, and $R^{10}$ is $C_1$-$C_6$-alkyl;

n is 1;

Q is O or S;

W is O;

X is O;

Y is O;

Z is selected from the group consisting of $Z^1$, $Z^4$, $Z^5$, $Z^6$ and $Z^7$ as defined above, wherein $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy;

more preferred are the uracilpyridines of formula (I) wherein $R^1$ is $CH_3$;

$R^2$ is $CF_3$;

$R^3$ is H;

$R^4$ is H, F or Cl;

$R^5$ is F, Cl, Br or CN;

$R^6$ is H, $CH_3$ or $OCH_3$;

$R^7$ is H;

$R^8$ is $OR^9$ or $NR^9S(O)_2R^{10}$; wherein $R^9$ is hydrogen, $C_1$-$C_6$-alkyl, $C_3$-$C_6$-alkenyl, or $C_3$-$C_6$-alkynyl, and $R^{10}$ is $C_1$-$C_6$-alkyl;

n is 1;

Q is O;

W is O;

X is O;

Y is O;

Z is selected from the group consisting of $Z^1$ and $Z^7$ as defined above, wherein $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy.

also more preferred are the uracilpyridines of formula (I) wherein $R^1$ is $CH_3$;

$R^2$ is $CF_3$;

$R^3$ is H;

$R^4$ is H, F or Cl;

$R^5$ is F, Cl or CN;

$R^6$ is H, $CH_3$ or $OCH_3$;

$R^7$ is H;

$R^8$ is $OR^9$ or $NR^9S(O)_2R^{10}$; wherein $R^9$ is hydrogen, $C_1$-$C_6$-alkyl, or $C_3$-$C_6$-alkynyl, and $R^{10}$ is $C_1$-$C_6$-alkyl;

n is 1;

Q is O;

W is O;

X is O;

Y is O;

Z is selected from the group consisting of $Z^1$ and $Z^7$ as defined above, wherein $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy.

Also preferred are the uracilpyridines of formula (I) wherein $R^1$ is $CH_3$;

$R^2$ is $CF_3$;

$R^3$ is H;

$R^4$ is H, F or Cl;

$R^5$ is F, Cl, Br or CN;

$R^6$ is H, $CH_3$ or $OCH_3$;

$R^7$ is H;

$R^8$ $OR^9$, $SR^9$, $NR^{10}R^{11}$, $NR^9OR^9$, $NR^9S(O)_2R^{10}$ or $NR^9S(O)_2NR^{10}R^{11}$, wherein $R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_1$-$C_6$-haloalkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-

$C_6$-alkyl, aminocarbonyl-$C_1$-$C_6$-alkyl, ($C_1$-$C_6$-alkyl) aminocarbonyl-$C_1$-$C_6$-alkyl, di($C_1$-$C_6$-alkyl) aminocarbonyl-$C_1$-$C_6$-alkyl, —N=$CR^{12}R^{13}$, wherein $R^{12}$ and $R^{13}$ independently of one another are H, $C_1$-$C_4$-alkyl or phenyl;

$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6 membered heteroaryl, wherein each cycloalkyl, heterocyclyl, phenyl or heteroaryl ring can be substituted by one to four substituents selected from $R^{14}$ or a 3- to 7-membered carbocyclus, which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;

wherein $R^{14}$ is halogen, $NO_2$, CN, $C_1$-$C_4$-alkyl, $C_1$-$C_4$-haloalkyl, $C_1$-$C_4$-alkoxy or $C_1$-$C_4$-alkoxycarbonyl;

$R^{10}$, $R^{11}$ independently of one another are $R^9$, or together form a 3- to 7-membered carbocyclus, which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;

n is 1;
Q is O;
W is O;
X is O;
Y is O;

Z is selected from the group consisting of $Z^1$ and $Z^7$ as defined above, wherein $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy.

Also preferred are the uracilpyridines of formula (I) wherein $R^1$ is $CH_3$;
$R^2$ is $CF_3$;
$R^3$ is H;
$R^4$ is H, F or Cl;
$R^5$ is F, Cl or CN;
$R^6$ is H, $CH_3$ or $OCH_3$;
$R^7$ is H;
$R^8$ $OR^9$, $SR^9$, $NR^{10}R^{11}$, $NR^9OR^9$, $NR^9S(O)_2R^{10}$ or $NR^9S(O)_2NR^{10}R^{11}$, wherein $R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy)$C_1$-$C_6$-alkyl, $C_1$-$C_6$-haloalkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl) aminocarbonyl-$C_1$-$C_6$-alkyl, di($C_1$-$C_6$-alkyl) aminocarbonyl-$C_1$-$C_6$-alkyl, —N=$CR^{12}R^{13}$, wherein $R^{12}$ and $R^{13}$ independently of one another are H, $C_1$-$C_4$-alkyl or phenyl;

$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6 membered heteroaryl, wherein each cycloalkyl, heterocyclyl, phenyl or heteroaryl ring can be substituted by one to four substituents selected from $R^{14}$ or a 3- to 7-membered carbocyclus, which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;

wherein $R^{14}$ is halogen, $NO_2$, CN, $C_1$-$C_4$-alkyl, $C_1$-$C_4$-haloalkyl, $C_1$-$C_4$-alkoxy or $C_1$-$C_4$-alkoxycarbonyl;

$R^{10}$, $R^{11}$ independently of one another are $R^9$, or together form a 3- to 7-membered carbocyclus, which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;

n is 1;
Q is O;
W is O;
X is O;
Y is O;

Z is selected from the group consisting of $Z^1$ and $Z^7$ as defined above, wherein $R^a$, $R^b$, $R^c$, $R^d$ and $R^e$ independently of one another are H, halogen, CN, $C_1$-$C_6$-alkyl, $C_1$-$C_6$-haloalkyl, $C_1$-$C_6$-alkoxy, $C_1$-$C_6$-haloalkoxy.

Particular preference is given to uracilpyrimidines of formula (I.a) (corresponds to formula (I) wherein $R^1$ is $CH_3$, $R^2$ is $CF_3$, $R^3$ is H, $R^7$ is H, n is 1, Q, W, X and Y are O, and Z is Z-1 as defined, wherein $R^a$, $R^b$, $R^c$ and $R^d$ are H:

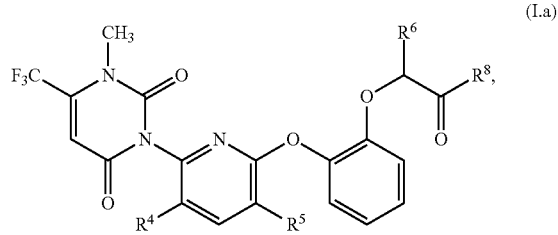

(I.a)

wherein the variables $R^4$, $R^5$, $R^6$ and $R^8$ have the meanings, in particular the preferred meanings, as defined above.

Special preference is given to the compounds of the formulae (I.a.1) to (I.a.672), preferably (I.a.1) to (I.a.504), of Table A, where the definitions of the variables $R^4$, $R^5$, $R^6$ and $R^8$ are of particular importance for the compounds according to the invention not only in combination with one another but in each case also on their own:

TABLE A

| No. | R⁴ | R⁵ | R⁶ | R⁸ |
|---|---|---|---|---|
| I.a.1 | H | F | H | OH |
| I.a.2 | H | F | H | $OCH_3$ |
| I.a.3 | H | F | H | $OC_2H_5$ |
| I.a.4 | H | F | H | $OCH(CH_3)_2$ |
| I.a.5 | H | F | H | $OCH_2CH_2CH_3$ |
| I.a.6 | H | F | H | $OCH_2CH(CH_3)_2$ |
| I.a.7 | H | F | H | $OCH_2CH=CH_2$ |
| I.a.8 | H | F | H | $OCH_2C\equiv CH$ |
| I.a.9 | H | F | H | $OCH_2CF_3$ |
| I.a.10 | H | F | H | $OCH_2CHF_2$ |
| I.a.11 | H | F | H | $OC_6H_5$ |
| I.a.12 | H | F | H | $OCH_2(C_6H_5)$ |
| I.a.13 | H | F | H | $OCH_2OCH_3$ |
| I.a.14 | H | F | H | $OCH_2OCH_2CH_3$ |
| I.a.15 | H | F | H | $OCH_2CH_2OCH_3$ |
| I.a.16 | H | F | H | $OCH_2CH_2OCH_2CH_3$ |
| I.a.17 | H | F | H | $OCH_2(CO)OCH_3$ |
| I.a.18 | H | F | H | $OCH_2(CO)OCH_2CH_3$ |
| I.a.19 | H | F | H | $OCH(CH_3)(CO)OCH_3$ |
| I.a.20 | H | F | H | $OCH(CH_3)(CO)OCH_2CH_3$ |
| I.a.21 | H | F | H | $OCH_2$-cyclopropyl |
| I.a.22 | H | F | H | $OCH_2$-cyclobutyl |
| I.a.23 | H | F | H | $SCH_3$ |
| I.a.24 | H | F | H | $SC_2H_5$ |
| I.a.25 | H | F | H | $NHSO_2CH_3$ |
| I.a.26 | H | F | H | $NHSO_2CH(CH_3)_2$ |
| I.a.27 | H | F | H | $NHSO_2N(CH_3)_2$ |
| I.a.28 | H | F | H | $NHSO_2N(CH_3)[CH(CH_3)_2]$ |
| I.a.29 | H | F | $CH_3$ | OH |
| I.a.30 | H | F | $CH_3$ | $OCH_3$ |
| I.a.31 | H | F | $CH_3$ | $OC_2H_5$ |
| I.a.32 | H | F | $CH_3$ | $OCH(CH_3)_2$ |
| I.a.33 | H | F | $CH_3$ | $OCH_2CH_2CH_3$ |
| I.a.34 | H | F | $CH_3$ | $OCH_2CH(CH_3)_2$ |
| I.a.35 | H | F | $CH_3$ | $OCH_2CH=CH_2$ |
| I.a.36 | H | F | $CH_3$ | $OCH_2C\equiv CH$ |
| I.a.37 | H | F | $CH_3$ | $OCH_2CF_3$ |
| I.a.38 | H | F | $CH_3$ | $OCH_2CHF_2$ |
| I.a.39 | H | F | $CH_3$ | $OC_6H_5$ |
| I.a.40 | H | F | $CH_3$ | $OCH_2(C_6H_5)$ |
| I.a.41 | H | F | $CH_3$ | $OCH_2OCH_3$ |
| I.a.42 | H | F | $CH_3$ | $OCH_2OCH_2CH_3$ |
| I.a.43 | H | F | $CH_3$ | $OCH_2CH_2OCH_3$ |
| I.a.44 | H | F | $CH_3$ | $OCH_2CH_2OCH_2CH_3$ |
| I.a.45 | H | F | $CH_3$ | $OCH_2(CO)OCH_3$ |
| I.a.46 | H | F | $CH_3$ | $OCH_2(CO)OCH_2CH_3$ |
| I.a.47 | H | F | $CH_3$ | $OCH(CH_3)(CO)OCH_3$ |
| I.a.48 | H | F | $CH_3$ | $OCH(CH_3)(CO)OCH_2CH_3$ |
| I.a.49 | H | F | $CH_3$ | $OCH_2$-cyclopropyl |
| I.a.50 | H | F | $CH_3$ | $OCH_2$-cyclobutyl |
| I.a.51 | H | F | $CH_3$ | $SCH_3$ |
| I.a.52 | H | F | $CH_3$ | $SC_2H_5$ |
| I.a.53 | H | F | $CH_3$ | $NHSO_2CH_3$ |
| I.a.54 | H | F | $CH_3$ | $NHSO_2CH(CH_3)_2$ |
| I.a.55 | H | F | $CH_3$ | $NHSO_2N(CH_3)_2$ |
| I.a.56 | H | F | $CH_3$ | $NHSO_2N(CH_3)[CH(CH_3)_2]$ |
| I.a.57 | H | F | $OCH_3$ | OH |
| I.a.58 | H | F | $OCH_3$ | $OCH_3$ |
| I.a.59 | H | F | $OCH_3$ | $OC_2H_5$ |
| I.a.60 | H | F | $OCH_3$ | $OCH(CH_3)_2$ |
| I.a.61 | H | F | $OCH_3$ | $OCH_2CH_2CH_3$ |
| I.a.62 | H | F | $OCH_3$ | $OCH_2CH(CH_3)_2$ |
| I.a.63 | H | F | $OCH_3$ | $OCH_2CH=CH_2$ |
| I.a.64 | H | F | $OCH_3$ | $OCH_2C\equiv CH$ |
| I.a.65 | H | F | $OCH_3$ | $OCH_2CF_3$ |
| I.a.66 | H | F | $OCH_3$ | $OCH_2CHF_2$ |
| I.a.67 | H | F | $OCH_3$ | $OC_6H_5$ |
| I.a.68 | H | F | $OCH_3$ | $OCH_2(C_6H_5)$ |
| I.a.69 | H | F | $OCH_3$ | $OCH_2OCH_3$ |
| I.a.70 | H | F | $OCH_3$ | $OCH_2OCH_2CH_3$ |
| I.a.71 | H | F | $OCH_3$ | $OCH_2CH_2OCH_3$ |
| I.a.72 | H | F | $OCH_3$ | $OCH_2CH_2OCH_2CH_3$ |
| I.a.73 | H | F | $OCH_3$ | $OCH_2(CO)OCH_3$ |
| I.a.74 | H | F | $OCH_3$ | $OCH_2(CO)OCH_2CH_3$ |
| I.a.75 | H | F | $OCH_3$ | $OCH(CH_3)(CO)OCH_3$ |
| I.a.76 | H | F | $OCH_3$ | $OCH(CH_3)(CO)OCH_2CH_3$ |
| I.a.77 | H | F | $OCH_3$ | $OCH_2$-cyclopropyl |
| I.a.78 | H | F | $OCH_3$ | $OCH_2$-cyclobutyl |
| I.a.79 | H | F | $OCH_3$ | $SCH_3$ |
| I.a.80 | H | F | $OCH_3$ | $SC_2H_5$ |
| I.a.81 | H | F | $OCH_3$ | $NHSO_2CH_3$ |
| I.a.82 | H | F | $OCH_3$ | $NHSO_2CH(CH_3)_2$ |
| I.a.83 | H | F | $OCH_3$ | $NHSO_2N(CH_3)_2$ |
| I.a.84 | H | F | $OCH_3$ | $NHSO_2N(CH_3)[CH(CH_3)_2]$ |
| I.a.85 | H | Cl | H | OH |
| I.a.86 | H | Cl | H | $OCH_3$ |
| I.a.87 | H | Cl | H | $OC_2H_5$ |
| I.a.88 | H | Cl | H | $OCH(CH_3)_2$ |
| I.a.89 | H | Cl | H | $OCH_2CH_2CH_3$ |
| I.a.90 | H | Cl | H | $OCH_2CH(CH_3)_2$ |
| I.a.91 | H | Cl | H | $OCH_2CH=CH_2$ |
| I.a.92 | H | Cl | H | $OCH_2C\equiv CH$ |
| I.a.93 | H | Cl | H | $OCH_2CF_3$ |
| I.a.94 | H | Cl | H | $OCH_2CHF_2$ |
| I.a.95 | H | Cl | H | $OC_6H_5$ |
| I.a.96 | H | Cl | H | $OCH_2(C_6H_5)$ |
| I.a.97 | H | Cl | H | $OCH_2OCH_3$ |
| I.a.98 | H | Cl | H | $OCH_2OCH_2CH_3$ |
| I.a.99 | H | Cl | H | $OCH_2CH_2OCH_3$ |
| I.a.100 | H | Cl | H | $OCH_2CH_2OCH_2CH_3$ |
| I.a.101 | H | Cl | H | $OCH_2(CO)OCH_3$ |
| I.a.102 | H | Cl | H | $OCH_2(CO)OCH_2CH_3$ |
| I.a.103 | H | Cl | H | $OCH(CH_3)(CO)OCH_3$ |
| I.a.104 | H | Cl | H | $OCH(CH_3)(CO)OCH_2CH_3$ |
| I.a.105 | H | Cl | H | $OCH_2$-cyclopropyl |
| I.a.106 | H | Cl | H | $OCH_2$-cyclobutyl |
| I.a.107 | H | Cl | H | $SCH_3$ |
| I.a.108 | H | Cl | H | $SC_2H_5$ |
| I.a.109 | H | Cl | H | $NHSO_2CH_3$ |
| I.a.110 | H | Cl | H | $NHSO_2CH(CH_3)_2$ |
| I.a.111 | H | Cl | H | $NHSO_2N(CH_3)_2$ |
| I.a.112 | H | Cl | H | $NHSO_2N(CH_3)[CH(CH_3)_2]$ |
| I.a.113 | H | Cl | $CH_3$ | OH |
| I.a.114 | H | Cl | $CH_3$ | $OCH_3$ |
| I.a.115 | H | Cl | $CH_3$ | $OC_2H_5$ |
| I.a.116 | H | Cl | $CH_3$ | $OCH(CH_3)_2$ |
| I.a.117 | H | Cl | $CH_3$ | $OCH_2CH_2CH_3$ |
| I.a.118 | H | Cl | $CH_3$ | $OCH_2CH(CH_3)_2$ |
| I.a.119 | H | Cl | $CH_3$ | $OCH_2CH=CH_2$ |
| I.a.120 | H | Cl | $CH_3$ | $OCH_2C\equiv CH$ |
| I.a.121 | H | Cl | $CH_3$ | $OCH_2CF_3$ |
| I.a.122 | H | Cl | $CH_3$ | $OCH_2CHF_2$ |
| I.a.123 | H | Cl | $CH_3$ | $OC_6H_5$ |
| I.a.124 | H | Cl | $CH_3$ | $OCH_2(C_6H_5)$ |
| I.a.125 | H | Cl | $CH_3$ | $OCH_2OCH_3$ |
| I.a.126 | H | Cl | $CH_3$ | $OCH_2OCH_2CH_3$ |
| I.a.127 | H | Cl | $CH_3$ | $OCH_2CH_2OCH_3$ |
| I.a.128 | H | Cl | $CH_3$ | $OCH_2CH_2OCH_2CH_3$ |
| I.a.129 | H | Cl | $CH_3$ | $OCH_2(CO)OCH_3$ |
| I.a.130 | H | Cl | $CH_3$ | $OCH_2(CO)OCH_2CH_3$ |
| I.a.131 | H | Cl | $CH_3$ | $OCH(CH_3)(CO)OCH_3$ |
| I.a.132 | H | Cl | $CH_3$ | $OCH(CH_3)(CO)OCH_2CH_3$ |
| I.a.133 | H | Cl | $CH_3$ | $OCH_2$-cyclopropyl |
| I.a.134 | H | Cl | $CH_3$ | $OCH_2$-cyclobutyl |
| I.a.135 | H | Cl | $CH_3$ | $SCH_3$ |
| I.a.136 | H | Cl | $CH_3$ | $SC_2H_5$ |
| I.a.137 | H | Cl | $CH_3$ | $NHSO_2CH_3$ |
| I.a.138 | H | Cl | $CH_3$ | $NHSO_2CH(CH_3)_2$ |
| I.a.139 | H | Cl | $CH_3$ | $NHSO_2N(CH_3)_2$ |
| I.a.140 | H | Cl | $CH_3$ | $NHSO_2N(CH_3)[CH(CH_3)_2]$ |
| I.a.141 | H | Cl | $OCH_3$ | OH |
| I.a.142 | H | Cl | $OCH_3$ | $OCH_3$ |
| I.a.143 | H | Cl | $OCH_3$ | $OC_2H_5$ |
| I.a.144 | H | Cl | $OCH_3$ | $OCH(CH_3)_2$ |
| I.a.145 | H | Cl | $OCH_3$ | $OCH_2CH_2CH_3$ |
| I.a.146 | H | Cl | $OCH_3$ | $OCH_2CH(CH_3)_2$ |
| I.a.147 | H | Cl | $OCH_3$ | $OCH_2CH=CH_2$ |
| I.a.148 | H | Cl | $OCH_3$ | $OCH_2C\equiv CH$ |
| I.a.149 | H | Cl | $OCH_3$ | $OCH_2CF_3$ |
| I.a.150 | H | Cl | $OCH_3$ | $OCH_2CHF_2$ |
| I.a.151 | H | Cl | $OCH_3$ | $OC_6H_5$ |
| I.a.152 | H | Cl | $OCH_3$ | $OCH_2(C_6H_5)$ |
| I.a.153 | H | Cl | $OCH_3$ | $OCH_2OCH_3$ |
| I.a.154 | H | Cl | $OCH_3$ | $OCH_2OCH_2CH_3$ |
| I.a.155 | H | Cl | $OCH_3$ | $OCH_2CH_2OCH_3$ |
| I.a.156 | H | Cl | $OCH_3$ | $OCH_2CH_2OCH_2CH_3$ |

TABLE A-continued

| No. | R⁴ | R⁵ | R⁶ | R⁸ |
|---|---|---|---|---|
| I.a.157 | H | Cl | OCH₃ | OCH₂(CO)OCH₃ |
| I.a.158 | H | Cl | OCH₃ | OCH₂(CO)OCH₂CH₃ |
| I.a.159 | H | Cl | OCH₃ | OCH(CH₃)(CO)OCH₃ |
| I.a.160 | H | Cl | OCH₃ | OCH(CH₃)(CO)OCH₂CH₃ |
| I.a.161 | H | Cl | OCH₃ | OCH₂-cyclopropyl |
| I.a.162 | H | Cl | OCH₃ | OCH₂-cyclobutyl |
| I.a.163 | H | Cl | OCH₃ | SCH₃ |
| I.a.164 | H | Cl | OCH₃ | SC₂H₅ |
| I.a.165 | H | Cl | OCH₃ | NHSO₂CH₃ |
| I.a.166 | H | Cl | OCH₃ | NHSO₂CH(CH₃)₂ |
| I.a.167 | H | Cl | OCH₃ | NHSO₂N(CH₃)₂ |
| I.a.168 | H | Cl | OCH₃ | NHSO₂N(CH₃)[CH(CH₃)₂] |
| I.a.169 | H | CN | H | OH |
| I.a.170 | H | CN | H | OCH₃ |
| I.a.171 | H | CN | H | OC₂H₅ |
| I.a.172 | H | CN | H | OCH(CH₃)₂ |
| I.a.173 | H | CN | H | OCH₂CH₂CH₃ |
| I.a.174 | H | CN | H | OCH₂CH(CH₃)₂ |
| I.a.175 | H | CN | H | OCH₂CH=CH₂ |
| I.a.176 | H | CN | H | OCH₂C≡CH |
| I.a.177 | H | CN | H | OCH₂CF₃ |
| I.a.178 | H | CN | H | OCH₂CHF₂ |
| I.a.179 | H | CN | H | OC₆H₅ |
| I.a.180 | H | CN | H | OCH₂(C₆H₅) |
| I.a.181 | H | CN | H | OCH₂OCH₃ |
| I.a.182 | H | CN | H | OCH₂OCH₂CH₃ |
| I.a.183 | H | CN | H | OCH₂CH₂OCH₃ |
| I.a.184 | H | CN | H | OCH₂CH₂OCH₂CH₃ |
| I.a.185 | H | CN | H | OCH₂(CO)OCH₃ |
| I.a.186 | H | CN | H | OCH₂(CO)OCH₂CH₃ |
| I.a.187 | H | CN | H | OCH(CH₃)(CO)OCH₃ |
| I.a.188 | H | CN | H | OCH(CH₃)(CO)OCH₂CH₃ |
| I.a.189 | H | CN | H | OCH₂-cyclopropyl |
| I.a.190 | H | CN | H | OCH₂-cyclobutyl |
| I.a.191 | H | CN | H | SCH₃ |
| I.a.192 | H | CN | H | SC₂H₅ |
| I.a.193 | H | CN | H | NHSO₂CH₃ |
| I.a.194 | H | CN | H | NHSO₂CH(CH₃)₂ |
| I.a.195 | H | CN | H | NHSO₂N(CH₃)₂ |
| I.a.196 | H | CN | H | NHSO₂N(CH₃)[CH(CH₃)₂] |
| I.a.197 | H | CN | CH₃ | OH |
| I.a.198 | H | CN | CH₃ | OCH₃ |
| I.a.199 | H | CN | CH₃ | OC₂H₅ |
| I.a.200 | H | CN | CH₃ | OCH(CH₃)₂ |
| I.a.201 | H | CN | CH₃ | OCH₂CH₂CH₃ |
| I.a.202 | H | CN | CH₃ | OCH₂CH(CH₃)₂ |
| I.a.203 | H | CN | CH₃ | OCH₂CH=CH₂ |
| I.a.204 | H | CN | CH₃ | OCH₂C≡CH |
| I.a.205 | H | CN | CH₃ | OCH₂CF₃ |
| I.a.206 | H | CN | CH₃ | OCH₂CHF₂ |
| I.a.207 | H | CN | CH₃ | OC₆H₅ |
| I.a.208 | H | CN | CH₃ | OCH₂(C₆H₅) |
| I.a.209 | H | CN | CH₃ | OCH₂OCH₃ |
| I.a.210 | H | CN | CH₃ | OCH₂OCH₂CH₃ |
| I.a.211 | H | CN | CH₃ | OCH₂CH₂OCH₃ |
| I.a.212 | H | CN | CH₃ | OCH₂CH₂OCH₂CH₃ |
| I.a.213 | H | CN | CH₃ | OCH₂(CO)OCH₃ |
| I.a.214 | H | CN | CH₃ | OCH₂(CO)OCH₂CH₃ |
| I.a.215 | H | CN | CH₃ | OCH(CH₃)(CO)OCH₃ |
| I.a.216 | H | CN | CH₃ | OCH(CH₃)(CO)OCH₂CH₃ |
| I.a.217 | H | CN | CH₃ | OCH₂-cyclopropyl |
| I.a.218 | H | CN | CH₃ | OCH₂-cyclobutyl |
| I.a.219 | H | CN | CH₃ | SCH₃ |
| I.a.220 | H | CN | CH₃ | SC₂H₅ |
| I.a.221 | H | CN | CH₃ | NHSO₂CH₃ |
| I.a.222 | H | CN | CH₃ | NHSO₂CH(CH₃)₂ |
| I.a.223 | H | CN | CH₃ | NHSO₂N(CH₃)₂ |
| I.a.224 | H | CN | CH₃ | NHSO₂N(CH₃)[CH(CH₃)₂] |
| I.a.225 | H | CN | OCH₃ | OH |
| I.a.226 | H | CN | OCH₃ | OCH₃ |
| I.a.227 | H | CN | OCH₃ | OC₂H₅ |
| I.a.228 | H | CN | OCH₃ | OCH(CH₃)₂ |
| I.a.229 | H | CN | OCH₃ | OCH₂CH₂CH₃ |
| I.a.230 | H | CN | OCH₃ | OCH₂CH(CH₃)₂ |
| I.a.231 | H | CN | OCH₃ | OCH₂CH=CH₂ |
| I.a.232 | H | CN | OCH₃ | OCH₂C≡CH |
| I.a.233 | H | CN | OCH₃ | OCH₂CF₃ |
| I.a.234 | H | CN | OCH₃ | OCH₂CHF₂ |
| I.a.235 | H | CN | OCH₃ | OC₆H₅ |
| I.a.236 | H | CN | OCH₃ | OCH₂(C₆H₅) |
| I.a.237 | H | CN | OCH₃ | OCH₂OCH₃ |
| I.a.238 | H | CN | OCH₃ | OCH₂OCH₂CH₃ |
| I.a.239 | H | CN | OCH₃ | OCH₂CH₂OCH₃ |
| I.a.240 | H | CN | OCH₃ | OCH₂CH₂OCH₂CH₃ |
| I.a.241 | H | CN | OCH₃ | OCH₂(CO)OCH₃ |
| I.a.242 | H | CN | OCH₃ | OCH₂(CO)OCH₂CH₃ |
| I.a.243 | H | CN | OCH₃ | OCH(CH₃)(CO)OCH₃ |
| I.a.244 | H | CN | OCH₃ | OCH(CH₃)(CO)OCH₂CH₃ |
| I.a.245 | H | CN | OCH₃ | OCH₂-cyclopropyl |
| I.a.246 | H | CN | OCH₃ | OCH₂-cyclobutyl |
| I.a.247 | H | CN | OCH₃ | SCH₃ |
| I.a.248 | H | CN | OCH₃ | SC₂H₅ |
| I.a.249 | H | CN | OCH₃ | NHSO₂CH₃ |
| I.a.250 | H | CN | OCH₃ | NHSO₂CH(CH₃)₂ |
| I.a.251 | H | CN | OCH₃ | NHSO₂N(CH₃)₂ |
| I.a.252 | H | CN | OCH₃ | NHSO₂N(CH₃)[CH(CH₃)₂] |
| I.a.253 | F | F | H | OH |
| I.a.254 | F | F | H | OCH₃ |
| I.a.255 | F | F | H | OC₂H₅ |
| I.a.256 | F | F | H | OCH(CH₃)₂ |
| I.a.257 | F | F | H | OCH₂CH₂CH₃ |
| I.a.258 | F | F | H | OCH₂CH(CH₃)₂ |
| I.a.259 | F | F | H | OCH₂CH=CH₂ |
| I.a.260 | F | F | H | OCH₂C≡CH |
| I.a.261 | F | F | H | OCH₂CF₃ |
| I.a.262 | F | F | H | OCH₂CHF₂ |
| I.a.263 | F | F | H | OC₆H₅ |
| I.a.264 | F | F | H | OCH₂(C₆H₅) |
| I.a.265 | F | F | H | OCH₂OCH₃ |
| I.a.266 | F | F | H | OCH₂OCH₂CH₃ |
| I.a.267 | F | F | H | OCH₂CH₂OCH₃ |
| I.a.268 | F | F | H | OCH₂CH₂OCH₂CH₃ |
| I.a.269 | F | F | H | OCH₂(CO)OCH₃ |
| I.a.270 | F | F | H | OCH₂(CO)OCH₂CH₃ |
| I.a.271 | F | F | H | OCH(CH₃)(CO)OCH₃ |
| I.a.272 | F | F | H | OCH(CH₃)(CO)OCH₂CH₃ |
| I.a.273 | F | F | H | OCH₂-cyclopropyl |
| I.a.274 | F | F | H | OCH₂-cyclobutyl |
| I.a.275 | F | F | H | SCH₃ |
| I.a.276 | F | F | H | SC₂H₅ |
| I.a.277 | F | F | H | NHSO₂CH₃ |
| I.a.278 | F | F | H | NHSO₂CH(CH₃)₂ |
| I.a.279 | F | F | H | NHSO₂N(CH₃)₂ |
| I.a.280 | F | F | H | NHSO₂N(CH₃)[CH(CH₃)₂] |
| I.a.281 | F | F | CH₃ | OH |
| I.a.282 | F | F | CH₃ | OCH₃ |
| I.a.283 | F | F | CH₃ | OC₂H₅ |
| I.a.284 | F | F | CH₃ | OCH(CH₃)₂ |
| I.a.285 | F | F | CH₃ | OCH₂CH₂CH₃ |
| I.a.286 | F | F | CH₃ | OCH₂CH(CH₃)₂ |
| I.a.287 | F | F | CH₃ | OCH₂CH=CH₂ |
| I.a.288 | F | F | CH₃ | OCH₂C≡CH |
| I.a.289 | F | F | CH₃ | OCH₂CF₃ |
| I.a.290 | F | F | CH₃ | OCH₂CHF₂ |
| I.a.291 | F | F | CH₃ | OC₆H₅ |
| I.a.292 | F | F | CH₃ | OCH₂(C₆H₅) |
| I.a.293 | F | F | CH₃ | OCH₂OCH₃ |
| I.a.294 | F | F | CH₃ | OCH₂OCH₂CH₃ |
| I.a.295 | F | F | CH₃ | OCH₂CH₂OCH₃ |
| I.a.296 | F | F | CH₃ | OCH₂CH₂OCH₂CH₃ |
| I.a.297 | F | F | CH₃ | OCH₂(CO)OCH₃ |
| I.a.298 | F | F | CH₃ | OCH₂(CO)OCH₂CH₃ |
| I.a.299 | F | F | CH₃ | OCH(CH₃)(CO)OCH₃ |
| I.a.300 | F | F | CH₃ | OCH(CH₃)(CO)OCH₂CH₃ |
| I.a.301 | F | F | CH₃ | OCH₂-cyclopropyl |
| I.a.302 | F | F | CH₃ | OCH₂-cyclobutyl |
| I.a.303 | F | F | CH₃ | SCH₃ |
| I.a.304 | F | F | CH₃ | SC₂H₅ |
| I.a.305 | F | F | CH₃ | NHSO₂CH₃ |
| I.a.306 | F | F | CH₃ | NHSO₂CH(CH₃)₂ |
| I.a.307 | F | F | CH₃ | NHSO₂N(CH₃)₂ |
| I.a.308 | F | F | CH₃ | NHSO₂N(CH₃)[CH(CH₃)₂] |
| I.a.309 | F | F | OCH₃ | OH |
| I.a.310 | F | F | OCH₃ | OCH₃ |
| I.a.311 | F | F | OCH₃ | OC₂H₅ |
| I.a.312 | F | F | OCH₃ | OCH(CH₃)₂ |

TABLE A-continued

| No. | R⁴ | R⁵ | R⁶ | R⁸ |
|---|---|---|---|---|
| I.a.313 | F | F | OCH₃ | OCH₂CH₂CH₃ |
| I.a.314 | F | F | OCH₃ | OCH₂CH(CH₃)₂ |
| I.a.315 | F | F | OCH₃ | OCH₂CH=CH₂ |
| I.a.316 | F | F | OCH₃ | OCH₂C≡CH |
| I.a.317 | F | F | OCH₃ | OCH₂CF₃ |
| I.a.318 | F | F | OCH₃ | OCH₂CHF₂ |
| I.a.319 | F | F | OCH₃ | OC₆H₅ |
| I.a.320 | F | F | OCH₃ | OCH₂(C₆H₅) |
| I.a.321 | F | F | OCH₃ | OCH₂OCH₃ |
| I.a.322 | F | F | OCH₃ | OCH₂OCH₂CH₃ |
| I.a.323 | F | F | OCH₃ | OCH₂CH₂OCH₃ |
| I.a.324 | F | F | OCH₃ | OCH₂CH₂OCH₂CH₃ |
| I.a.325 | F | F | OCH₃ | OCH₂(CO)OCH₃ |
| I.a.326 | F | F | OCH₃ | OCH₂(CO)OCH₂CH₃ |
| I.a.327 | F | F | OCH₃ | OCH(CH₃)(CO)OCH₃ |
| I.a.328 | F | F | OCH₃ | OCH(CH₃)(CO)OCH₂CH₃ |
| I.a.329 | F | F | OCH₃ | OCH₂-cyclopropyl |
| I.a.330 | F | F | OCH₃ | OCH₂-cyclobutyl |
| I.a.331 | F | F | OCH₃ | SCH₃ |
| I.a.332 | F | F | OCH₃ | SC₂H₅ |
| I.a.333 | F | F | OCH₃ | NHSO₂CH₃ |
| I.a.334 | F | F | OCH₃ | NHSO₂CH(CH₃)₂ |
| I.a.335 | F | F | OCH₃ | NHSO₂N(CH₃)₂ |
| I.a.336 | F | F | OCH₃ | NHSO₂N(CH₃)[CH(CH₃)₂] |
| I.a.337 | F | Cl | H | OH |
| I.a.338 | F | Cl | H | OCH₃ |
| I.a.339 | F | Cl | H | OC₂H₅ |
| I.a.340 | F | Cl | H | OCH(CH₃)₂ |
| I.a.341 | F | Cl | H | OCH₂CH₂CH₃ |
| I.a.342 | F | Cl | H | OCH₂CH(CH₃)₂ |
| I.a.343 | F | Cl | H | OCH₂CH=CH₂ |
| I.a.344 | F | Cl | H | OCH₂C≡CH |
| I.a.345 | F | Cl | H | OCH₂CF₃ |
| I.a.346 | F | Cl | H | OCH₂CHF₂ |
| I.a.347 | F | Cl | H | OC₆H₅ |
| I.a.348 | F | Cl | H | OCH₂(C₆H₅) |
| I.a.349 | F | Cl | H | OCH₂OCH₃ |
| I.a.350 | F | Cl | H | OCH₂OCH₂CH₃ |
| I.a.351 | F | Cl | H | OCH₂CH₂OCH₃ |
| I.a.352 | F | Cl | H | OCH₂CH₂OCH₂CH₃ |
| I.a.353 | F | Cl | H | OCH₂(CO)OCH₃ |
| I.a.354 | F | Cl | H | OCH₂(CO)OCH₂CH₃ |
| I.a.355 | F | Cl | H | OCH(CH₃)(CO)OCH₃ |
| I.a.356 | F | Cl | H | OCH(CH₃)(CO)OCH₂CH₃ |
| I.a.357 | F | Cl | H | OCH₂-cyclopropyl |
| I.a.358 | F | Cl | H | OCH₂-cyclobutyl |
| I.a.359 | F | Cl | H | SCH₃ |
| I.a.360 | F | Cl | H | SC₂H₅ |
| I.a.361 | F | Cl | H | NHSO₂CH₃ |
| I.a.362 | F | Cl | H | NHSO₂CH(CH₃)₂ |
| I.a.363 | F | Cl | H | NHSO₂N(CH₃)₂ |
| I.a.364 | F | Cl | H | NHSO₂N(CH₃)[CH(CH₃)₂] |
| I.a.365 | F | Cl | CH₃ | OH |
| I.a.366 | F | Cl | CH₃ | OCH₃ |
| I.a.367 | F | Cl | CH₃ | OC₂H₅ |
| I.a.368 | F | Cl | CH₃ | OCH(CH₃)₂ |
| I.a.369 | F | Cl | CH₃ | OCH₂CH₂CH₃ |
| I.a.370 | F | Cl | CH₃ | OCH₂CH(CH₃)₂ |
| I.a.371 | F | Cl | CH₃ | OCH₂CH=CH₂ |
| I.a.372 | F | Cl | CH₃ | OCH₂C≡CH |
| I.a.373 | F | Cl | CH₃ | OCH₂CF₃ |
| I.a.374 | F | Cl | CH₃ | OCH₂CHF₂ |
| I.a.375 | F | Cl | CH₃ | OC₆H₅ |
| I.a.376 | F | Cl | CH₃ | OCH₂(C₆H₅) |
| I.a.377 | F | Cl | CH₃ | OCH₂OCH₃ |
| I.a.378 | F | Cl | CH₃ | OCH₂OCH₂CH₃ |
| I.a.379 | F | Cl | CH₃ | OCH₂CH₂OCH₃ |
| I.a.380 | F | Cl | CH₃ | OCH₂CH₂OCH₂CH₃ |
| I.a.381 | F | Cl | CH₃ | OCH₂(CO)OCH₃ |
| I.a.382 | F | Cl | CH₃ | OCH₂(CO)OCH₂CH₃ |
| I.a.383 | F | Cl | CH₃ | OCH(CH₃)(CO)OCH₃ |
| I.a.384 | F | Cl | CH₃ | OCH(CH₃)(CO)OCH₂CH₃ |
| I.a.385 | F | Cl | CH₃ | OCH₂-cyclopropyl |
| I.a.386 | F | Cl | CH₃ | OCH₂-cyclobutyl |
| I.a.387 | F | Cl | CH₃ | SCH₃ |
| I.a.388 | F | Cl | CH₃ | SC₂H₅ |
| I.a.389 | F | Cl | CH₃ | NHSO₂CH₃ |
| I.a.390 | F | Cl | CH₃ | NHSO₂CH(CH₃)₂ |
| I.a.391 | F | Cl | CH₃ | NHSO₂N(CH₃)₂ |
| I.a.392 | F | Cl | CH₃ | NHSO₂N(CH₃)[CH(CH₃)₂] |
| I.a.393 | F | Cl | OCH₃ | OH |
| I.a.394 | F | Cl | OCH₃ | OCH₃ |
| I.a.395 | F | Cl | OCH₃ | OC₂H₅ |
| I.a.396 | F | Cl | OCH₃ | OCH(CH₃)₂ |
| I.a.397 | F | Cl | OCH₃ | OCH₂CH₂CH₃ |
| I.a.398 | F | Cl | OCH₃ | OCH₂CH(CH₃)₂ |
| I.a.399 | F | Cl | OCH₃ | OCH₂CH=CH₂ |
| I.a.400 | F | Cl | OCH₃ | OCH₂C≡CH |
| I.a.401 | F | Cl | OCH₃ | OCH₂CF₃ |
| I.a.402 | F | Cl | OCH₃ | OCH₂CHF₂ |
| I.a.403 | F | Cl | OCH₃ | OC₆H₅ |
| I.a.404 | F | Cl | OCH₃ | OCH₂(C₆H₅) |
| I.a.405 | F | Cl | OCH₃ | OCH₂OCH₃ |
| I.a.406 | F | Cl | OCH₃ | OCH₂OCH₂CH₃ |
| I.a.407 | F | Cl | OCH₃ | OCH₂CH₂OCH₃ |
| I.a.408 | F | Cl | OCH₃ | OCH₂CH₂OCH₂CH₃ |
| I.a.409 | F | Cl | OCH₃ | OCH₂(CO)OCH₃ |
| I.a.410 | F | Cl | OCH₃ | OCH₂(CO)OCH₂CH₃ |
| I.a.411 | F | Cl | OCH₃ | OCH(CH₃)(CO)OCH₃ |
| I.a.412 | F | Cl | OCH₃ | OCH(CH₃)(CO)OCH₂CH₃ |
| I.a.413 | F | Cl | OCH₃ | OCH₂-cyclopropyl |
| I.a.414 | F | Cl | OCH₃ | OCH₂-cyclobutyl |
| I.a.415 | F | Cl | OCH₃ | SCH₃ |
| I.a.416 | F | Cl | OCH₃ | SC₂H₅ |
| I.a.417 | F | Cl | OCH₃ | NHSO₂CH₃ |
| I.a.418 | F | Cl | OCH₃ | NHSO₂CH(CH₃)₂ |
| I.a.419 | F | Cl | OCH₃ | NHSO₂N(CH₃)₂ |
| I.a.420 | F | Cl | OCH₃ | NHSO₂N(CH₃)[CH(CH₃)₂] |
| I.a.421 | F | CN | H | OH |
| I.a.422 | F | CN | H | OCH₃ |
| I.a.423 | F | CN | H | OC₂H₅ |
| I.a.424 | F | CN | H | OCH(CH₃)₂ |
| I.a.425 | F | CN | H | OCH₂CH₂CH₃ |
| I.a.426 | F | CN | H | OCH₂CH(CH₃)₂ |
| I.a.427 | F | CN | H | OCH₂CH=CH₂ |
| I.a.428 | F | CN | H | OCH₂C≡CH |
| I.a.429 | F | CN | H | OCH₂CF₃ |
| I.a.430 | F | CN | H | OCH₂CHF₂ |
| I.a.431 | F | CN | H | OC₆H₅ |
| I.a.432 | F | CN | H | OCH₂(C₆H₅) |
| I.a.433 | F | CN | H | OCH₂OCH₃ |
| I.a.434 | F | CN | H | OCH₂OCH₂CH₃ |
| I.a.435 | F | CN | H | OCH₂CH₂OCH₃ |
| I.a.436 | F | CN | H | OCH₂CH₂OCH₂CH₃ |
| I.a.437 | F | CN | H | OCH₂(CO)OCH₃ |
| I.a.438 | F | CN | H | OCH₂(CO)OCH₂CH₃ |
| I.a.439 | F | CN | H | OCH(CH₃)(CO)OCH₃ |
| I.a.440 | F | CN | H | OCH(CH₃)(CO)OCH₂CH₃ |
| I.a.441 | F | CN | H | OCH₂-cyclopropyl |
| I.a.442 | F | CN | H | OCH₂-cyclobutyl |
| I.a.443 | F | CN | H | SCH₃ |
| I.a.444 | F | CN | H | SC₂H₅ |
| I.a.445 | F | CN | H | NHSO₂CH₃ |
| I.a.446 | F | CN | H | NHSO₂CH(CH₃)₂ |
| I.a.447 | F | CN | H | NHSO₂N(CH₃)₂ |
| I.a.448 | F | CN | H | NHSO₂N(CH₃)[CH(CH₃)₂] |
| I.a.449 | F | CN | CH₃ | OH |
| I.a.450 | F | CN | CH₃ | OCH₃ |
| I.a.451 | F | CN | CH₃ | OC₂H₅ |
| I.a.452 | F | CN | CH₃ | OCH(CH₃)₂ |
| I.a.453 | F | CN | CH₃ | OCH₂CH₂CH₃ |
| I.a.454 | F | CN | CH₃ | OCH₂CH(CH₃)₂ |
| I.a.455 | F | CN | CH₃ | OCH₂CH=CH₂ |
| I.a.456 | F | CN | CH₃ | OCH₂C≡CH |
| I.a.457 | F | CN | CH₃ | OCH₂CF₃ |
| I.a.458 | F | CN | CH₃ | OCH₂CHF₂ |
| I.a.459 | F | CN | CH₃ | OC₆H₅ |
| I.a.460 | F | CN | CH₃ | OCH₂(C₆H₅) |
| I.a.461 | F | CN | CH₃ | OCH₂OCH₃ |
| I.a.462 | F | CN | CH₃ | OCH₂OCH₂CH₃ |
| I.a.463 | F | CN | CH₃ | OCH₂CH₂OCH₃ |
| I.a.464 | F | CN | CH₃ | OCH₂CH₂OCH₂CH₃ |
| I.a.465 | F | CN | CH₃ | OCH₂(CO)OCH₃ |
| I.a.466 | F | CN | CH₃ | OCH₂(CO)OCH₂CH₃ |
| I.a.467 | F | CN | CH₃ | OCH(CH₃)(CO)OCH₃ |
| I.a.468 | F | CN | CH₃ | OCH(CH₃)(CO)OCH₂CH₃ |

TABLE A-continued

| No. | $R^4$ | $R^5$ | $R^6$ | $R^8$ |
|---|---|---|---|---|
| I.a.469 | F | CN | CH$_3$ | OCH$_2$-cyclopropyl |
| I.a.470 | F | CN | CH$_3$ | OCH$_2$-cyclobutyl |
| I.a.471 | F | CN | CH$_3$ | SCH$_3$ |
| I.a.472 | F | CN | CH$_3$ | SC$_2$H$_5$ |
| I.a.473 | F | CN | CH$_3$ | NHSO$_2$CH$_3$ |
| I.a.474 | F | CN | CH$_3$ | NHSO$_2$CH(CH$_3$)$_2$ |
| I.a.475 | F | CN | CH$_3$ | NHSO$_2$N(CH$_3$)$_2$ |
| I.a.476 | F | CN | CH$_3$ | NHSO$_2$N(CH$_3$)[CH(CH$_3$)$_2$] |
| I.a.477 | F | CN | OCH$_3$ | OH |
| I.a.478 | F | CN | OCH$_3$ | OCH$_3$ |
| I.a.479 | F | CN | OCH$_3$ | OC$_2$H$_5$ |
| I.a.480 | F | CN | OCH$_3$ | OCH(CH$_3$)$_2$ |
| I.a.481 | F | CN | OCH$_3$ | OCH$_2$CH$_2$CH$_3$ |
| I.a.482 | F | CN | OCH$_3$ | OCH$_2$CH(CH$_3$)$_2$ |
| I.a.483 | F | CN | OCH$_3$ | OCH$_2$CH=CH$_2$ |
| I.a.484 | F | CN | OCH$_3$ | OCH$_2$C≡CH |
| I.a.485 | F | CN | OCH$_3$ | OCH$_2$CF$_3$ |
| I.a.486 | F | CN | OCH$_3$ | OCH$_2$CHF$_2$ |
| I.a.487 | F | CN | OCH$_3$ | OC$_6$H$_5$ |
| I.a.488 | F | CN | OCH$_3$ | OCH$_2$(C$_6$H$_5$) |
| I.a.489 | F | CN | OCH$_3$ | OCH$_2$OCH$_3$ |
| I.a.490 | F | CN | OCH$_3$ | OCH$_2$OCH$_2$CH$_3$ |
| I.a.491 | F | CN | OCH$_3$ | OCH$_2$CH$_2$OCH$_3$ |
| I.a.492 | F | CN | OCH$_3$ | OCH$_2$CH$_2$OCH$_2$CH$_3$ |
| I.a.493 | F | CN | OCH$_3$ | OCH$_2$(CO)OCH$_3$ |
| I.a.494 | F | CN | OCH$_3$ | OCH$_2$(CO)OCH$_2$CH$_3$ |
| I.a.495 | F | CN | OCH$_3$ | OCH(CH$_3$)(CO)OCH$_3$ |
| I.a.496 | F | CN | OCH$_3$ | OCH(CH$_3$)(CO)OCH$_2$CH$_3$ |
| I.a.497 | F | CN | OCH$_3$ | OCH$_2$-cyclopropyl |
| I.a.498 | F | CN | OCH$_3$ | OCH$_2$-cyclobutyl |
| I.a.499 | F | CN | OCH$_3$ | SCH$_3$ |
| I.a.500 | F | CN | OCH$_3$ | SC$_2$H$_5$ |
| I.a.501 | F | CN | OCH$_3$ | NHSO$_2$CH$_3$ |
| I.a.502 | F | CN | OCH$_3$ | NHSO$_2$CH(CH$_3$)$_2$ |
| I.a.503 | F | CN | OCH$_3$ | NHSO$_2$N(CH$_3$)$_2$ |
| I.a.504 | F | CN | OCH$_3$ | NHSO$_2$N(CH$_3$)[CH(CH$_3$)$_2$] |
| I.a.505 | H | Br | H | OH |
| I.a.506 | H | Br | H | OCH$_3$ |
| I.a.507 | H | Br | H | OC$_2$H$_5$ |
| I.a.508 | H | Br | H | OCH(CH$_3$)$_2$ |
| I.a.509 | H | Br | H | OCH$_2$CH$_2$CH$_3$ |
| I.a.510 | H | Br | H | OCH$_2$CH(CH$_3$)$_2$ |
| I.a.511 | H | Br | H | OCH$_2$CH=CH$_2$ |
| I.a.512 | H | Br | H | OCH$_2$C≡CH |
| I.a.513 | H | Br | H | OCH$_2$CF$_3$ |
| I.a.514 | H | Br | H | OCH$_2$CHF$_2$ |
| I.a.515 | H | Br | H | OC$_6$H$_5$ |
| I.a.516 | H | Br | H | OCH$_2$(C$_6$H$_5$) |
| I.a.517 | H | Br | H | OCH$_2$OCH$_3$ |
| I.a.518 | H | Br | H | OCH$_2$OCH$_2$CH$_3$ |
| I.a.519 | H | Br | H | OCH$_2$CH$_2$OCH$_3$ |
| I.a.520 | H | Br | H | OCH$_2$CH$_2$OCH$_2$CH$_3$ |
| I.a.521 | H | Br | H | OCH$_2$(CO)OCH$_3$ |
| I.a.522 | H | Br | H | OCH$_2$(CO)OCH$_2$CH$_3$ |
| I.a.523 | H | Br | H | OCH(CH$_3$)(CO)OCH$_3$ |
| I.a.524 | H | Br | H | OCH(CH$_3$)(CO)OCH$_2$CH$_3$ |
| I.a.525 | H | Br | H | OCH$_2$-cyclopropyl |
| I.a.526 | H | Br | H | OCH$_2$-cyclobutyl |
| I.a.527 | H | Br | H | SCH$_3$ |
| I.a.528 | H | Br | H | SC$_2$H$_5$ |
| I.a.529 | H | Br | H | NHSO$_2$CH$_3$ |
| I.a.530 | H | Br | H | NHSO$_2$CH(CH$_3$)$_2$ |
| I.a.531 | H | Br | H | NHSO$_2$N(CH$_3$)$_2$ |
| I.a.532 | H | Br | H | NHSO$_2$N(CH$_3$)[CH(CH$_3$)$_2$] |
| I.a.533 | H | Br | CH$_3$ | OH |
| I.a.534 | H | Br | CH$_3$ | OCH$_3$ |
| I.a.535 | H | Br | CH$_3$ | OC$_2$H$_5$ |
| I.a.536 | H | Br | CH$_3$ | OCH(CH$_3$)$_2$ |
| I.a.537 | H | Br | CH$_3$ | OCH$_2$CH$_2$CH$_3$ |
| I.a.538 | H | Br | CH$_3$ | OCH$_2$CH(CH$_3$)$_2$ |
| I.a.539 | H | Br | CH$_3$ | OCH$_2$CH=CH$_2$ |
| I.a.540 | H | Br | CH$_3$ | OCH$_2$C≡CH |
| I.a.541 | H | Br | CH$_3$ | OCH$_2$CF$_3$ |
| I.a.542 | H | Br | CH$_3$ | OCH$_2$CHF$_2$ |
| I.a.543 | H | Br | CH$_3$ | OC$_6$H$_5$ |
| I.a.544 | H | Br | CH$_3$ | OCH$_2$(C$_6$H$_5$) |
| I.a.545 | H | Br | CH$_3$ | OCH$_2$OCH$_3$ |
| I.a.546 | H | Br | CH$_3$ | OCH$_2$OCH$_2$CH$_3$ |
| I.a.547 | H | Br | CH$_3$ | OCH$_2$CH$_2$OCH$_3$ |
| I.a.548 | H | Br | CH$_3$ | OCH$_2$CH$_2$OCH$_2$CH$_3$ |
| I.a.549 | H | Br | CH$_3$ | OCH$_2$(CO)OCH$_3$ |
| I.a.550 | H | Br | CH$_3$ | OCH$_2$(CO)OCH$_2$CH$_3$ |
| I.a.551 | H | Br | CH$_3$ | OCH(CH$_3$)(CO)OCH$_3$ |
| I.a.552 | H | Br | CH$_3$ | OCH(CH$_3$)(CO)OCH$_2$CH$_3$ |
| I.a.553 | H | Br | CH$_3$ | OCH$_2$-cyclopropyl |
| I.a.554 | H | Br | CH$_3$ | OCH$_2$-cyclobutyl |
| I.a.555 | H | Br | CH$_3$ | SCH$_3$ |
| I.a.556 | H | Br | CH$_3$ | SC$_2$H$_5$ |
| I.a.557 | H | Br | CH$_3$ | NHSO$_2$CH$_3$ |
| I.a.558 | H | Br | CH$_3$ | NHSO$_2$CH(CH$_3$)$_2$ |
| I.a.559 | H | Br | CH$_3$ | NHSO$_2$N(CH$_3$)$_2$ |
| I.a.560 | H | Br | CH$_3$ | NHSO$_2$N(CH$_3$)[CH(CH$_3$)$_2$] |
| I.a.561 | H | Br | OCH$_3$ | OH |
| I.a.562 | H | Br | OCH$_3$ | OCH$_3$ |
| I.a.563 | H | Br | OCH$_3$ | OC$_2$H$_5$ |
| I.a.564 | H | Br | OCH$_3$ | OCH(CH$_3$)$_2$ |
| I.a.565 | H | Br | OCH$_3$ | OCH$_2$CH$_2$CH$_3$ |
| I.a.566 | H | Br | OCH$_3$ | OCH$_2$CH(CH$_3$)$_2$ |
| I.a.567 | H | Br | OCH$_3$ | OCH$_2$CH=CH$_2$ |
| I.a.568 | H | Br | OCH$_3$ | OCH$_2$C≡CH |
| I.a.569 | H | Br | OCH$_3$ | OCH$_2$CF$_3$ |
| I.a.570 | H | Br | OCH$_3$ | OCH$_2$CHF$_2$ |
| I.a.571 | H | Br | OCH$_3$ | OC$_6$H$_5$ |
| I.a.572 | H | Br | OCH$_3$ | OCH$_2$(C$_6$H$_5$) |
| I.a.573 | H | Br | OCH$_3$ | OCH$_2$OCH$_3$ |
| I.a.574 | H | Br | OCH$_3$ | OCH$_2$OCH$_2$CH$_3$ |
| I.a.575 | H | Br | OCH$_3$ | OCH$_2$CH$_2$OCH$_3$ |
| I.a.576 | H | Br | OCH$_3$ | OCH$_2$CH$_2$OCH$_2$CH$_3$ |
| I.a.577 | H | Br | OCH$_3$ | OCH$_2$(CO)OCH$_3$ |
| I.a.578 | H | Br | OCH$_3$ | OCH$_2$(CO)OCH$_2$CH$_3$ |
| I.a.579 | H | Br | OCH$_3$ | OCH(CH$_3$)(CO)OCH$_3$ |
| I.a.580 | H | Br | OCH$_3$ | OCH(CH$_3$)(CO)OCH$_2$CH$_3$ |
| I.a.581 | H | Br | OCH$_3$ | OCH$_2$-cyclopropyl |
| I.a.582 | H | Br | OCH$_3$ | OCH$_2$-cyclobutyl |
| I.a.583 | H | Br | OCH$_3$ | SCH$_3$ |
| I.a.584 | H | Br | OCH$_3$ | SC$_2$H$_5$ |
| I.a.585 | H | Br | OCH$_3$ | NHSO$_2$CH$_3$ |
| I.a.586 | H | Br | OCH$_3$ | NHSO$_2$CH(CH$_3$)$_2$ |
| I.a.587 | H | Br | OCH$_3$ | NHSO$_2$N(CH$_3$)$_2$ |
| I.a.588 | H | Br | OCH$_3$ | NHSO$_2$N(CH$_3$)[CH(CH$_3$)$_2$] |
| I.a.589 | F | Br | H | OH |
| I.a.590 | F | Br | H | OCH$_3$ |
| I.a.591 | F | Br | H | OC$_2$H$_5$ |
| I.a.592 | F | Br | H | OCH(CH$_3$)$_2$ |
| I.a.593 | F | Br | H | OCH$_2$CH$_2$CH$_3$ |
| I.a.594 | F | Br | H | OCH$_2$CH(CH$_3$)$_2$ |
| I.a.595 | F | Br | H | OCH$_2$CH=CH$_2$ |
| I.a.596 | F | Br | H | OCH$_2$C≡CH |
| I.a.597 | F | Br | H | OCH$_2$CF$_3$ |
| I.a.598 | F | Br | H | OCH$_2$CHF$_2$ |
| I.a.599 | F | Br | H | OC$_6$H$_5$ |
| I.a.600 | F | Br | H | OCH$_2$(C$_6$H$_5$) |
| I.a.601 | F | Br | H | OCH$_2$OCH$_3$ |
| I.a.602 | F | Br | H | OCH$_2$OCH$_2$CH$_3$ |
| I.a.603 | F | Br | H | OCH$_2$CH$_2$OCH$_3$ |
| I.a.604 | F | Br | H | OCH$_2$CH$_2$OCH$_2$CH$_3$ |
| I.a.605 | F | Br | H | OCH$_2$(CO)OCH$_3$ |
| I.a.606 | F | Br | H | OCH$_2$(CO)OCH$_2$CH$_3$ |
| I.a.607 | F | Br | H | OCH(CH$_3$)(CO)OCH$_3$ |
| I.a.608 | F | Br | H | OCH(CH$_3$)(CO)OCH$_2$CH$_3$ |
| I.a.609 | F | Br | H | OCH$_2$-cyclopropyl |
| I.a.610 | F | Br | H | OCH$_2$-cyclobutyl |
| I.a.611 | F | Br | H | SCH$_3$ |
| I.a.612 | F | Br | H | SC$_2$H$_5$ |
| I.a.613 | F | Br | H | NHSO$_2$CH$_3$ |
| I.a.614 | F | Br | H | NHSO$_2$CH(CH$_3$)$_2$ |
| I.a.615 | F | Br | H | NHSO$_2$N(CH$_3$)$_2$ |
| I.a.616 | F | Br | H | NHSO$_2$N(CH$_3$)[CH(CH$_3$)$_2$] |
| I.a.617 | F | Br | CH$_3$ | OH |
| I.a.618 | F | Br | CH$_3$ | OCH$_3$ |
| I.a.619 | F | Br | CH$_3$ | OC$_2$H$_5$ |
| I.a.620 | F | Br | CH$_3$ | OCH(CH$_3$)$_2$ |
| I.a.621 | F | Br | CH$_3$ | OCH$_2$CH$_2$CH$_3$ |
| I.a.622 | F | Br | CH$_3$ | OCH$_2$CH(CH$_3$)$_2$ |
| I.a.623 | F | Br | CH$_3$ | OCH$_2$CH=CH$_2$ |
| I.a.624 | F | Br | CH$_3$ | OCH$_2$C≡CH |

TABLE A-continued

| No. | R⁴ | R⁵ | R⁶ | R⁸ |
|---|---|---|---|---|
| I.a.625 | F | Br | CH₃ | OCH₂CF₃ |
| I.a.626 | F | Br | CH₃ | OCH₂CHF₂ |
| I.a.627 | F | Br | CH₃ | OC₆H₅ |
| I.a.628 | F | Br | CH₃ | OCH₂(C₆H₅) |
| I.a.629 | F | Br | CH₃ | OCH₂OCH₃ |
| I.a.630 | F | Br | CH₃ | OCH₂OCH₂CH₃ |
| I.a.631 | F | Br | CH₃ | OCH₂CH₂OCH₃ |
| I.a.632 | F | Br | CH₃ | OCH₂CH₂OCH₂CH₃ |
| I.a.633 | F | Br | CH₃ | OCH₂(CO)OCH₃ |
| I.a.634 | F | Br | CH₃ | OCH₂(CO)OCH₂CH₃ |
| I.a.635 | F | Br | CH₃ | OCH(CH₃)(CO)OCH₃ |
| I.a.636 | F | Br | CH₃ | OCH(CH₃)(CO)OCH₂CH₃ |
| I.a.637 | F | Br | CH₃ | OCH₂-cyclopropyl |
| I.a.638 | F | Br | CH₃ | OCH₂-cyclobutyl |
| I.a.639 | F | Br | CH₃ | SCH₃ |
| I.a.640 | F | Br | CH₃ | SC₂H₅ |
| I.a.641 | F | Br | CH₃ | NHSO₂CH₃ |
| I.a.642 | F | Br | CH₃ | NHSO₂CH(CH₃)₂ |
| I.a.643 | F | Br | CH₃ | NHSO₂N(CH₃)₂ |
| I.a.644 | F | Br | CH₃ | NHSO₂N(CH₃)[CH(CH₃)₂] |
| I.a.645 | F | Br | OCH₃ | OH |
| I.a.646 | F | Br | OCH₃ | OCH₃ |
| I.a.647 | F | Br | OCH₃ | OC₂H₅ |
| I.a.648 | F | Br | OCH₃ | OCH(CH₃)₂ |
| I.a.649 | F | Br | OCH₃ | OCH₂CH₂CH₃ |
| I.a.650 | F | Br | OCH₃ | OCH₂CH(CH₃)₂ |
| I.a.651 | F | Br | OCH₃ | OCH₂CH=CH₂ |
| I.a.652 | F | Br | OCH₃ | OCH₂C≡CH |
| I.a.653 | F | Br | OCH₃ | OCH₂CF₃ |
| I.a.654 | F | Br | OCH₃ | OCH₂CHF₂ |
| I.a.655 | F | Br | OCH₃ | OC₆H₅ |
| I.a.656 | F | Br | OCH₃ | OCH₂(C₆H₅) |
| I.a.657 | F | Br | OCH₃ | OCH₂OCH₃ |
| I.a.658 | F | Br | OCH₃ | OCH₂OCH₂CH₃ |
| I.a.659 | F | Br | OCH₃ | OCH₂CH₂OCH₃ |
| I.a.660 | F | Br | OCH₃ | OCH₂CH₂OCH₂CH₃ |
| I.a.661 | F | Br | OCH₃ | OCH₂(CO)OCH₃ |
| I.a.662 | F | Br | OCH₃ | OCH₂(CO)OCH₂CH₃ |
| I.a.663 | F | Br | OCH₃ | OCH(CH₃)(CO)OCH₃ |
| I.a.664 | F | Br | OCH₃ | OCH(CH₃)(CO)OCH₂CH₃ |
| I.a.665 | F | Br | OCH₃ | OCH₂-cyclopropyl |
| I.a.666 | F | Br | OCH₃ | OCH₂-cyclobutyl |
| I.a.667 | F | Br | OCH₃ | SCH₃ |
| I.a.668 | F | Br | OCH₃ | SC₂H₅ |
| I.a.669 | F | Br | OCH₃ | NHSO₂CH₃ |
| I.a.670 | F | Br | OCH₃ | NHSO₂CH(CH₃)₂ |
| I.a.671 | F | Br | OCH₃ | NHSO₂N(CH₃)₂ |
| I.a.672 | F | Br | OCH₃ | NHSO₂N(CH₃)[CH(CH₃)₂] |

Also preferred are the uracilpyridines of formula (I.b), preferably the uracilpyridines of formulae (I.b.1) to (I.b.672), particularly preferred the uracilpyridines of formulae (I.b.1) to (I.b.504), which differ from the corresponding uracilpyridines of formulae (I.a.1) to (I.a.672) only in that Q is S:

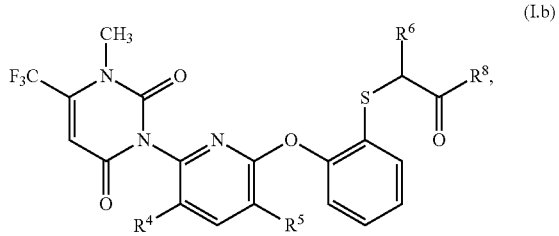

(I.b)

Also preferred are the uracilpyridines of formula (I.c), preferably the uracilpyridines of formulae (I.c.1) to (I.c.672), particularly preferred the uracilpyridines of formulae (I.c.1) to (I.c.504), which differ from the corresponding uracilpyridines of formulae (I.a.1) to (I.a.672) only in that Z is Z-2, wherein $R^a$, $R^b$, $R^d$ and $R^e$ are H:

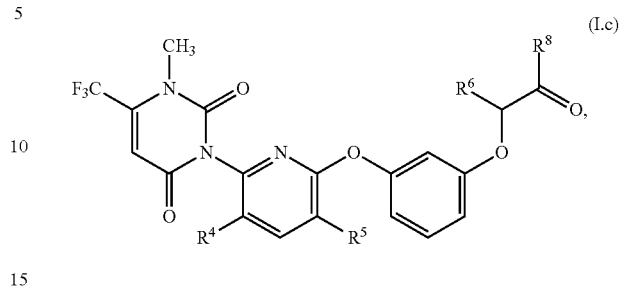

(I.c)

Also preferred are the uracilpyridines of formula (I.d), preferably the uracilpyridines of formulae (I.d.1) to (I.d.672), particularly preferred the uracilpyridines of formulae (I.d.1) to (I.d.504), which differ from the corresponding uracilpyridines of formulae (I.a.1) to (I.a.672) only in that Z is Z-3, wherein $R^a$, $R^b$, $R^d$ and $R^e$ are H:

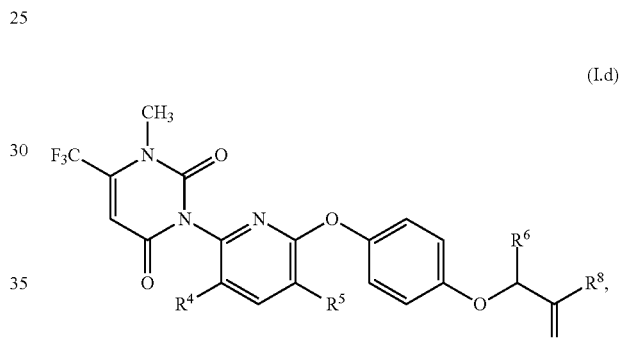

(I.d)

Also preferred are the uracilpyridines of formula (I.e), preferably the uracilpyridines of formulae (I.e.1) to (I.e.672), particularly preferred the uracilpyridines of formulae (I.e.1) to (I.e.504), which differ from the corresponding uracilpyridines of formulae (I.a.1) to (I.a.672) only in that Z is Z-4, wherein $R^b$, $R^c$ and $R^d$ are H:

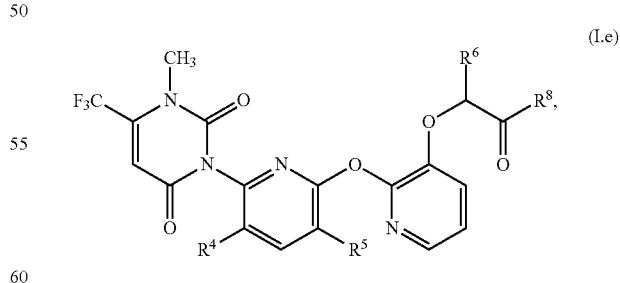

(I.e)

Also preferred are the uracilpyridines of formula (I.f), preferably the uracilpyridines of formulae (I.f.1) to (I.f.672), particularly preferred the uracilpyridines of formulae (I.f.1) to (I.f.504), which differ from the corresponding uracilpyridines of formulae (I.a.1) to (I.a.672) only in that Z is Z-5, wherein $R^a$, $R^c$ and $R^d$ are H:

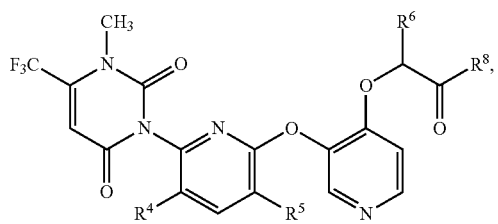

(I.f)

Also preferred are the uracilpyridines of formula (I.g), preferably the uracilpyridines of formulae (I.g.1) to (I.g.672), particularly preferred the uracilpyridines of formulae (I.g.1) to (I.g.504), which differ from the corresponding uracilpyridines of formulae (I.a.1) to (I.a.672) only in that Z is Z-6, wherein $R^a$, $R^b$ and $R^d$ are H:

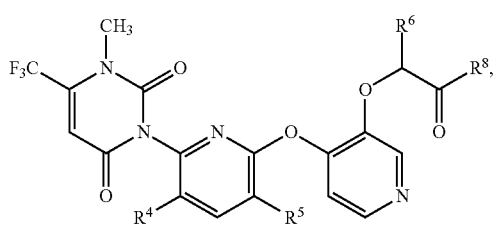

(I.g)

Also preferred are the uracilpyridines of formula (I.h), preferably the uracilpyridines of formulae (I.h.1) to (I.h.672), particularly preferred the uracilpyridines of formulae (I.h.1) to (I.h.504), which differ from the corresponding uracilpyridines of formulae (I.a.1) to (I.a.672) only in that Z is Z-7, wherein $R^a$, $R^b$ and $R^c$ are H:

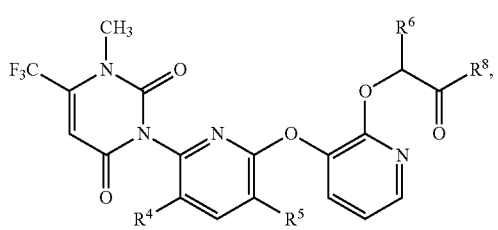

(I.h)

Also preferred are the uracilpyridines of formula (I.i), preferably the uracilpyridines of formulae (I.i.1) to (I.i.672), particularly preferred the uracilpyridines of formulae (I.i.1) to (I.i.504), which differ from the corresponding uracilpyridines of formulae (I.a.1) to (I.a.672) only in that Z is Z-7, wherein $R^a$, $R^b$ and $R^c$ are H, and Q is S:

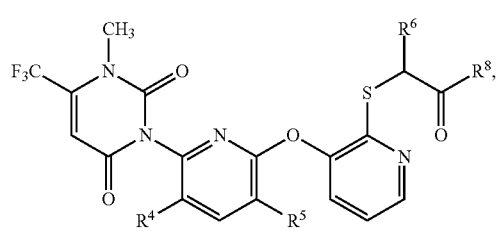

(I.i)

Also preferred are the uracilpyridines of formula (I.k), preferably the uracilpyridines of formulae (I.k.1) to (I.k.672), particularly preferred the uracilpyridines of formulae (I.k.1) to (I.k.504), which differ from the corresponding uracilpyridines of formulae (I.a.1) to (I.a.672) only in that Z is Z-8, wherein $R^b$, $R^c$ and $R^e$ are H:

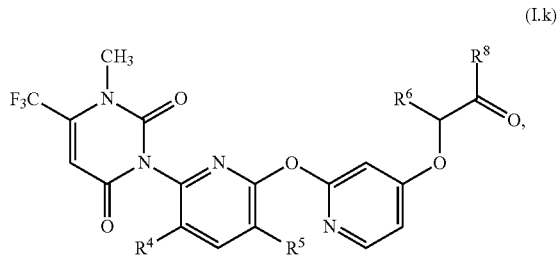

(I.k)

Also preferred are the uracilpyridines of formula (I.l), preferably the uracilpyridines of formulae (I.l.1) to (I.l.672), particularly preferred the uracilpyridines of formulae (I.l.1) to (I.l.504), which differ from the corresponding uracilpyridines of formulae (I.a.1) to (I.a.672) only in that Z is Z-9, wherein $R^a$, $R^c$ and $R^e$ are H:

(I.l)

Also preferred are the uracilpyridines of formula (I.m), preferably the uracilpyridines of formulae (I.m.1) to (I.m.672), particularly preferred the uracilpyridines of formulae (I.m.1) to (I.m.504), which differ from the corresponding uracilpyridines of formulae (I.a.1) to (I.a.672) only in that Z is Z-10, wherein $R^a$, $R^b$ and $R^e$ are H:

(I.m)

Also preferred are the uracilpyridines of formula (I.n), preferably the uracilpyridines of formulae (I.n.1) to (I.n.672), particularly preferred the uracilpyridines of formulae (I.n.1) to (I.n.504), which differ from the corresponding uracilpyridines of formulae (I.a.1) to (I.a.672) only in that Z is Z-11, wherein $R^a$, $R^b$ and $R^c$ are H:

(I.n)

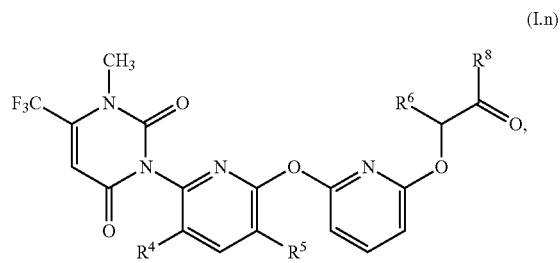

Also preferred are the uracilpyridines of formula (I.o), preferably the uracilpyridines of formulae (I.o.1) to (I.o.672), particularly preferred the uracilpyridines of formulae (I.o.1) to (I.o.504), which differ from the corresponding uracilpyridines of formulae (I.a.1) to (I.a.672) only in that Z is Z-12, wherein $R^b$, $R^d$ and $R^e$ are H:

(I.o)

Also preferred are the uracilpyridines of formula (I.p), preferably the uracilpyridines of formulae (I.p.1) to (I.p.672), particularly preferred the uracilpyridines of formulae (I.p.1) to (I.p.504), which differ from the corresponding uracilpyridines of formulae (I.a.1) to (I.a.672) only in that Z is Z-13, wherein $R^a$, $R^d$ and $R^e$ are H:

(I.p)

Also preferred are the uracilpyridines of formula (I.q), preferably the uracilpyridines of formulae (I.q.1) to (I.q.672), particularly preferred the uracilpyridines of formulae (I.q.1) to (I.q.504), which differ from the corresponding uracilpyridines of formulae (I.a.1) to (I.a.672) only in that Z is Z-21, wherein $R^a$ and $R^c$ are H:

(I.q)

To widen the spectrum of action and to achieve synergistic effects, the uracilpyridines of formula (I) may be mixed with a large number of representatives of other herbicidal or growth-regulating active ingredient groups and then applied concomitantly. Suitable components for mixtures are, for example, herbicides from the classes of the acetamides, amides, aryloxyphenoxypropionates, benzamides, benzofuran, benzoic acids, benzothiadiazinones, bipyridylium, carbamates, chloroacetamides, chlorocarboxylic acids, cyclohexanediones, dinitroanilines, dinitrophenol, diphenyl ether, glycines, imidazolinones, isoxazoles, isoxazolidinones, nitriles, N-phenylphthalimides, oxadiazoles, oxazolidinediones, oxyacetamides, phenoxycarboxylic acids, phenylcarbamates, phenylpyrazoles, phenylpyrazolines, phenylpyridazines, phosphinic acids, phosphoroamidates, phosphorodithioates, phthalamates, pyrazoles, pyridazinones, pyridines, pyridinecarboxylic acids, pyridinecarboxamides, pyrimidinediones, pyrimidinyl(thio)benzoates, quinolinecarboxylic acids, semicarbazones, sulfonylaminocarbonyltriazolinones, sulfonylureas, tetrazolinones, thiadiazoles, thiocarbamates, triazines, triazinones, triazoles, triazolinones, triazolocarboxamides, triazolopyrimidines, triketones, uracils, ureas.

It may furthermore be beneficial to apply the uracilpyridines of formula (I) alone or in combination with other herbicides, or else in the form of a mixture with other crop protection agents, for example together with agents for controlling pests or phytopathogenic fungi or bacteria. Also of interest is the miscibility with mineral salt solutions, which are employed for treating nutritional and trace element deficiencies. Other additives such as non-phytotoxic oils and oil concentrates may also be added.

In one embodiment of the present invention the compositions according to the present invention comprise at least one uracilpyridine of formula (I) (compound A) and at least one further active compound selected from herbicides B, preferably herbicides B of class b1) to b15), and safeners C (compound C).

In another embodiment of the present invention the compositions according to the present invention comprise at least one uracilpyridine of formula (I) and at least one further active compound B (herbicide B).

The further herbicidal compound B (component B) is preferably selected from the herbicides of class b1) to b15):

b1) lipid biosynthesis inhibitors;
b2) acetolactate synthase inhibitors (ALS inhibitors);
b3) photosynthesis inhibitors;
b4) protoporphyrinogen-IX oxidase inhibitors,
b5) bleacher herbicides;
b6) enolpyruvyl shikimate 3-phosphate synthase inhibitors (EPSP inhibitors);
b7) glutamine synthetase inhibitors;
b8) 7,8-dihydropteroate synthase inhibitors (DHP inhibitors);

b9) mitosis inhibitors;

b10) inhibitors of the synthesis of very long chain fatty acids (VLCFA inhibitors);

b11) cellulose biosynthesis inhibitors;

b12) decoupler herbicides;

b13) auxinic herbicides;

b14) auxin transport inhibitors; and b15) other herbicides selected from the group consisting of bromobutide, chlorflurenol, chlorflurenol-methyl, cinmethylin, cumyluron, dalapon, dazomet, difenzoquat, difenzoquat-metilsulfate, dimethipin, DSMA, dymron, endothal and its salts, etobenzanid, flamprop, flamprop-isopropyl, flamprop-methyl, flamprop-M-isopropyl, flamprop-M-methyl, flurenol, flurenol-butyl, flurprimidol, fosamine, fosamine-ammonium, indanofan, indaziflam, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine, triaziflam, tridiphane and 6-chloro-3-(2-cyclopropyl-6-methylphenoxy)-4-pyridazinol (CAS 499223-49-3) and its salts and esters;

including their agriculturally acceptable salts or derivatives.

Preference is given to those compositions according to the present invention comprising at least one herbicide B selected from herbicides of class b2, b3, b4, b5, b6, b7, b9, b10 and b13.

Specific preference is given to those compositions according to the present invention which comprise at least one herbicide B selected from the herbicides of class b4, b6, b7, b9, b10 and b13.

Particular preference is given to those compositions according to the present invention which comprise at least one herbicide B selected from the herbicides of class b4, b6, b10 and b13.

Examples of herbicides B which can be used in combination with the uracilpyridines of formula (I) of formula (I) according to the present invention are:

b1) from the group of the lipid biosynthesis inhibitors:

ACC-herbicides such as alloxydim, alloxydim-sodium, butroxydim, clethodim, clodinafop, clodinafop-propargyl, cycloxydim, cyhalofop, cyhalofop-butyl, diclofop, diclofop-methyl, fenoxaprop, fenoxaprop-ethyl, fenoxaprop-P, fenoxaprop-P-ethyl, fluazifop, fluazifop-butyl, fluazifop-P, fluazifop-P-butyl, haloxyfop, haloxyfop-methyl, haloxyfop-P, haloxyfop-P-methyl, metamifop, pinoxaden, profoxydim, propaquizafop, quizalofop, quizalofop-ethyl, quizalofop-tefuryl, quizalofop-P, quizalofop-P-ethyl, quizalofop-P-tefuryl, sethoxydim, tepraloxydim, tralkoxydim, 4-(4'-Chloro-4-cyclopropyl-2'-fluoro[1,1'-biphenyl]-3-yl)-5-hydroxy-2,2,6,6-tetramethyl-2H-pyran-3 (6H)-one (CAS 1312337-72-6); 4-(2',4'-Dichloro-4-cyclopropyl[1,1'-biphenyl]-3-yl)-5-hydroxy-2,2,6,6-tetramethyl-2H-pyran-3 (6H)-one (CAS 1312337-45-3); 4-(4'-Chloro-4-ethyl-2'-fluoro[1,1'-biphenyl]-3-yl)-5-hydroxy-2,2,6,6-tetramethyl-2H-pyran-3(6H)-one (CAS 1033757-93-5); 4-(2',4'-Dichloro-4-ethyl[1,1'-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1'-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1'-biphenyl]-3-yl)-3,6-dihydro-2,2,6,6-tetramethyl-2H-pyran-3-one; 5-(Acetyloxy)-4-(4'-chloro-4-ethyl-2'-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-biphenyl]-3-yl)-5,6-dihydro-2,2,6,6-tetramethyl-5-oxo-2H-pyran-3-yl carbonic acid methyl ester (CAS 1312337-51-1); 4-(2',4'-Dichloro-4-cyclopropyl-[1,1'-biphenyl]-3-yl)-5,6-dihydro-2,2,6,6-tetramethyl-5-oxo-2H-pyran-3-yl carbonic acid methyl ester; 4-(4'-Chloro-4-ethyl-2'-fluoro[1,1'-biphenyl]-3-yl)-5,6-dihydro-2,2,6,6-tetramethyl-5-oxo-2H-pyran-3-yl carbonic acid methyl ester (CAS 1312340-83-2); 4-(2',4'-Dichloro-4-ethyl[1,1'-biphenyl]-3-yl)-5,6-dihydro-2,2,6,6-tetramethyl-5-oxo-2H-pyran-3-yl carbonic acid methyl ester (CAS 1033760-58-5); and non ACC herbicides such as benfuresate, butylate, cycloate, dalapon, dimepiperate, EPTC, esprocarb, ethofumesate, flupropanate, molinate, orbencarb, pebulate, prosulfocarb, TCA, thiobencarb, tiocarbazil, triallate and vernolate;

b2) from the group of the ALS inhibitors:

sulfonylureas such as amidosulfuron, azimsulfuron, bensulfuron, bensulfuron-methyl, chlorimuron, chlorimuron-ethyl, chlorsulfuron, cinosulfuron, cyclosulfamuron, ethametsulfuron, ethametsulfuron-methyl, ethoxysulfuron, flazasulfuron, flucetosulfuron, flupyrsulfuron, flupyrsulfuron-methyl-sodium, foramsulfuron, halosulfuron, halosulfuron-methyl, imazosulfuron, iodosulfuron, iodosulfuron-methyl-sodium, iofensulfuron, iofensulfuron-sodium, mesosulfuron, metazosulfuron, metsulfuron, metsulfuron-methyl, nicosulfuron, orthosulfamuron, oxasulfuron, primisulfuron, primisulfuron-methyl, propyrisulfuron, prosulfuron, pyrazosulfuron, pyrazosulfuron-ethyl, rimsulfuron, sulfometuron, sulfometuron-methyl, sulfosulfuron, thifensulfuron, thifensulfuron-methyl, triasulfuron, tribenuron, tribenuron-methyl, trifloxysulfuron, triflusulfuron, triflusulfuron-methyl and tritosulfuron, imidazolinones such as imazamethabenz, imazamethabenz-methyl, imazamox, imazapic, imazapyr, imazaquin and imazethapyr, triazolopyrimidine herbicides and sulfonanilides such as cloransulam, cloransulam-methyl, diclosulam, flumetsulam, florasulam, metosulam, penoxsulam, pyrimisulfan and pyroxsulam, pyrimidinylbenzoates such as bispyribac, bispyribac-sodium, pyribenzoxim, pyriftalid, pyriminobac, pyriminobac-methyl, pyrithiobac, pyrithiobac-sodium, 4-[[[2-[(4,6-dimethoxy-2-pyrimidinyl)oxy]phenyl]methyl]amino]-benzoic acid-1-methylethyl ester (CAS 420138-41-6), 4-[[[2-[(4,6-dimethoxy-2-pyrimidinyl)oxy]phenyl]methyl]amino]-benzoic acid propyl ester (CAS 420138-40-5), N-(4-bromophenyl)-2-[(4,6-dimethoxy-2-pyrimidinyl)oxy] benzenemethanamine (CAS 420138-01-8), sulfonylaminocarbonyl-triazolinone herbicides such as flucarbazone, flucarbazone-sodium, propoxycarbazone, propoxycarbazone-sodium, thiencarbazone and thiencarbazone-methyl; and triafamone;

among these, a preferred embodiment of the invention relates to those compositions comprising at least one imidazolinone herbicide;

b3) from the group of the photosynthesis inhibitors:

amicarbazone, inhibitors of the photosystem II, e.g. 1-(6-tert-butylpyrimidin-4-yl)-2-hydroxy-4-methoxy-3-methyl-2H-pyrrol-5-one (CAS 1654744-66-7), 1-(5-tert-butylisoxazol-3-yl)-2-hydroxy-4-methoxy-3-methyl-2H-pyrrol-5-one (CAS 1637455-12-9), 1-(5-tert-butylisoxazol-3-yl)-4-chloro-2-hydroxy-3-methyl-2H-pyrrol-5-one (CAS 1637453-94-1), 1-(5-tert-butyl-1-methyl-pyrazol-3-yl)-4-chloro-2-hydroxy-3-methyl-2H-pyrrol-5-one (CAS 1654057-29-0), 1-(5-tert-butyl-1-methyl-pyrazol-3-yl)-3-chloro-2-hydroxy-4-methyl-2H-pyrrol-5-one (CAS 1654747-80-4), 4-hydroxy-1-methoxy-5-methyl-3-[4-(trifluoromethyl)-2-pyridyl]imidazolidin-2-one; (CAS 2023785-78-4), 4-hydroxy-1,5-dimethyl-3-[4-(trifluoromethyl)-2-pyridyl]imidazolidin-2-one (CAS 2023785-79-5), 5-ethoxy-4-hydroxy-1-methyl-3-[4-(trifluoromethyl)-2-pyridyl]imidazolidin-2-one (CAS 1701416-69-4), 4-hydroxy-1-methyl-3-[4-(trifluoromethyl)-2-pyridyl]imidazolidin-2-one (CAS 1708087-22-2), 4-hydroxy-1,5-dimethyl-3-[1-methyl-5-(trifluoromethyl)pyrazol-3-yl]imidazolidin-2-one (CAS 2023785-80-8), 1-(5-tert-butylisoxazol-3-yl)-4-ethoxy-5-hydroxy-3-methyl-imidazolidin-2-one (CAS 1844836-64-1), triazine herbicides, including of chlorotriazine, triazinones, triazindiones, methylthiotriazines and pyridazinones such as ametryn, atrazine, chloridazon, cyanazine, desmetryn, dimethametryn, hexazinone, metribuzin, prometon, prometryn, propazine, simazine, simetryn, terbumeton, terbuthylazin, terbutryn and trietazin, aryl urea such as chlorobromuron, chlorotoluron, chloroxuron, dimefuron, diuron, fluometuron, isoproturon, isouron, linuron, metamitron, methabenzthiazuron, metobenzuron, metoxuron, monolinuron, neburon, siduron, tebuthiuron and thiadiazuron, phenyl carbamates such as desmedipham, karbutilat, phenmedipham, phenmedipham-ethyl, nitrile herbicides such as bromofenoxim, bromoxynil and its salts and esters, ioxynil and its salts and esters, uraciles such as bromacil, lenacil and terbacil, and bentazon and bentazon-sodium, pyridate, pyridafol, pentanochlor and propanil and inhibitors of the photosystem I such as diquat, diquat-dibromide, paraquat, paraquat-dichloride and paraquat-dimetilsulfate. Among these, a preferred embodiment of the invention relates to those compositions comprising at least one aryl urea herbicide. Among these, likewise a preferred embodiment of the invention relates to those compositions comprising at least one triazine herbicide. Among these, likewise a preferred embodiment of the invention relates to those compositions comprising at least one nitrile herbicide;

b4) from the group of the protoporphyrinogen-IX oxidase inhibitors:

acifluorfen, acifluorfen-sodium, azafenidin, bencarbazone, benzfendizone, bifenox, butafenacil, carfentrazone, carfentrazone-ethyl, chlomethoxyfen, chlorphtalim, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, trifludimoxazin, ethyl [3-[2-chloro-4-fluoro-5-(1-methyl-6-trifluoromethyl-2,4-dioxo-1,2,3,4-tetrahydropyrimidin-3-yl) phenoxy]-2-pyridyloxy]acetate (CAS 353292-31-6; S-3100, N-ethyl-3-(2,6-dichloro-4-trifluoro-methylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoro-methylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione (CAS 451484-50-7), 2-(2,2,7-trifluoro-3-oxo-4-prop-2-ynyl-3,4-dihydro-2H-benzo[1,4]oxazin-6-yl)-4,5,6,7-tetrahydro-isoindole-1, 3-dione (CAS 1300118-96-0), 1-methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione (CAS 1304113-05-0), methyl (E)-4-[2-chloro-5-[4-chloro-5-(difluoromethoxy)-1H-methyl-pyrazol-3-yl]-4-fluoro-phenoxy]-3-methoxy-but-2-enoate (CAS 948893-00-3), and 3-[7-chloro-5-fluoro-2-(trifluoromethyl)-1H-benzimidazol-4-yl]-1-methyl-6-(trifluoromethyl)-1H-pyrimidine-2,4-dione (CAS 212754-02-4);

b5) from the group of the bleacher herbicides:

PDS inhibitors: beflubutamid, diflufenican, fluridone, flurochloridone, flurtamone, norflurazon, picolinafen, and 4-(3-trifluoromethylphenoxy)-2-(4-trifluoromethylphenyl) pyrimidine (CAS 180608-33-7), HPPD inhibitors: benzobicyclon, benzofenap, bicyclopyrone, clomazone, fenquinotrione, isoxaflutole, mesotrione, oxotrione (CAS 1486617-21-3), pyrasulfotole, pyrazolynate, pyrazoxyfen, sulcotrione, tefuryltrione, tembotrione, tolpyralate, topramezone, bleacher, unknown target: aclonifen, amitrole flumeturon and 2-chloro-3-methylsulfanyl-N-(1-methyltetrazol-5-yl)-4-(trifluoromethyl)benzamide (CAS 1361139-71-0), 2-(2,4-dichlorophenyl)methyl-4,4-dimethyl-3-isoxazolidone (CAS 81777-95-9) and 2-(2,5-dichlorophenyl)methyl-4,4-dimethyl-3-isoxazolidinone (CAS 81778-66-7);

b6) from the group of the EPSP synthase inhibitors:

glyphosate, glyphosate-isopropylammonium, glyposate-potassium and glyphosate-trimesium (sulfosate);

b7) from the group of the glutamine synthase inhibitors:

bilanaphos (bialaphos), bilanaphos-sodium, glufosinate, glufosinate-P and glufosinate-ammonium;

b8) from the group of the DHP synthase inhibitors:

asulam;

b9) from the group of the mitosis inhibitors:

compounds of group K1: dinitroanilines such as benfluralin, butralin, dinitramine, ethalfluralin, fluchloralin, oryzalin, pendimethalin, prodiamine and trifluralin, phosphoramidates such as amiprophos, amiprophos-methyl, and butamiphos, benzoic acid herbicides such as chlorthal, chlorthal-dimethyl, pyridines such as dithiopyr and thiazopyr, benzamides such as propyzamide and tebutam; compounds of group K2: carbetamide, chlorpropham, flamprop, flamprop-isopropyl, flamprop-methyl, flamprop-M-isopropyl, flamprop-M-methyl and propham; among these, compounds of group K1, in particular dinitroanilines are preferred;

b10) from the group of the VLCFA inhibitors:

chloroacetamides such as acetochlor, alachlor, amidochlor, butachlor, dimethachlor, dimethenamid, dimethenamid-P, metazachlor, metolachlor, metolachlor-S, pethoxamid, pretilachlor, propachlor, propisochlor and thenylchlor, oxyacetanilides such as flufenacet and mefenacet, acetanilides such as diphenamid, naproanilide, napropamide and napropamide-M, tetrazolinones such fentrazamide, and other herbicides such as anilofos, cafenstrole, fenoxasulfone, ipfencarbazone, piperophos, pyroxasulfone and isoxazoline compounds of the formulae II.1, II.2, II.3, II.4, II.5, II.6, II.7, II.8 and II.9

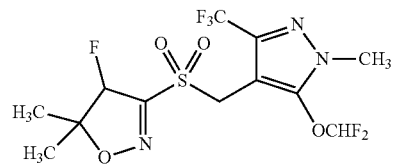

II.1

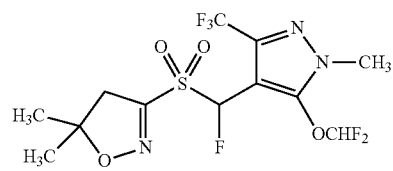

II.2

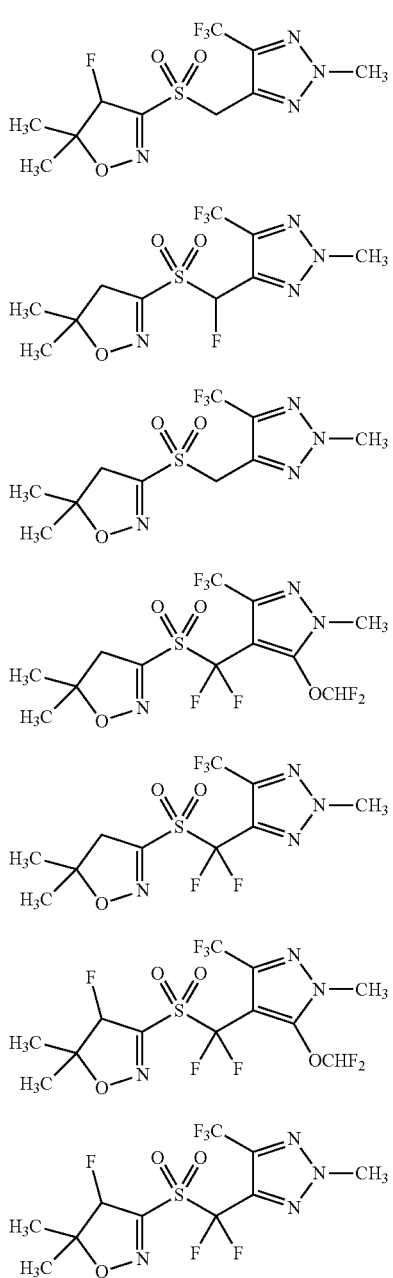

the isoxazoline compounds of the formula (I)I are known in the art, e.g. from WO 2006/024820, WO 2006/037945, WO 2007/071900 and WO 2007/096576;

among the VLCFA inhibitors, preference is given to chloroacetamides and oxyacetamides;

b11) from the group of the cellulose biosynthesis inhibitors:

chlorthiamid, dichlobenil, flupoxam, indaziflam, isoxaben, triaziflam and 1-cyclohexyl-5-pentafluorphenyloxy-1[4]-[1,2,4,6]thiatriazin-3-ylamine (CAS 175899-01-1);

b12) from the group of the decoupler herbicides:
dinoseb, dinoterb and DNOC and its salts;

b13) from the group of the auxinic herbicides:
2,4-D and its salts and esters such as clacyfos, 2,4-DB and its salts and esters, aminocyclopyrachlor and its salts and esters, aminopyralid and its salts such as aminopyralid-dimethylammonium, aminopyralid-tris(2-hydroxypropyl) ammonium and its esters, benazolin, benazolin-ethyl, chloramben and its salts and esters, clomeprop, clopyralid and its salts and esters, dicamba and its salts and esters, dichlorprop and its salts and esters, dichlorprop-P and its salts and esters, flopyrauxifen, fluroxypyr, fluroxypyr-butometyl, fluroxypyr-meptyl, halauxifen and its salts and esters (CAS 943832-60-8); MCPA and its salts and esters, MCPA-thioethyl, MCPB and its salts and esters, mecoprop and its salts and esters, mecoprop-P and its salts and esters, picloram and its salts and esters, quinclorac, quinmerac, TBA (2,3,6) and its salts and esters, triclopyr and its salts and esters, florpyrauxifen, florpyrauxifen-benzyl (CAS 1390661-72-9) and 4-amino-3-chloro-5-fluoro-6-(7-fluoro-1H-indol-6-yl)picolinic acid (CAS 1629965-65-6);

b14) from the group of the auxin transport inhibitors: diflufenzopyr, diflufenzopyr-sodium, naptalam and naptalam-sodium;

b15) from the group of the other herbicides: bromobutide, chlorflurenol, chlorflurenol-methyl, cinmethylin, cumyluron, cyclopyrimorate (CAS 499223-49-3) and its salts and esters, dalapon, dazomet, difenzoquat, difenzoquat-metilsulfate, dimethipin, DSMA, dymron, endothal and its salts, etobenzanid, flurenol, flurenol-butyl, flurprimidol, fosamine, fosamine-ammonium, indanofan, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine and tridiphane.

Active compounds B and C having a carboxyl group can be employed in the form of the acid, in the form of an agriculturally suitable salt as mentioned above or else in the form of an agriculturally acceptable derivative in the compositions according to the invention.

In the case of dicamba, suitable salts include those, where the counterion is an agriculturally acceptable cation. For example, suitable salts of dicamba are dicamba-sodium, dicamba-potassium, dicamba-methylammonium, dicamba-dimethylammonium, dicamba-isopropylammonium, dicamba-diglycolamine, dicamba-olamine, dicamba-diolamine, dicamba-trolamine, dicamba-N,N-bis-(3-aminopropyl)methylamine and dicamba-diethylenetriamine. Examples of a suitable ester are dicamba-methyl and dicamba-butotyl.

Suitable salts of 2,4-D are 2,4-D-ammonium, 2,4-D-dimethylammonium, 2,4-D-diethylammonium, 2,4-D-diethanolammonium (2,4-D-diolamine), 2,4-D-triethanolammonium, 2,4-D-isopropylammonium, 2,4-D-triisopropanolammonium, 2,4-D-heptylammonium, 2,4-D-dodecylammonium, 2,4-D-tetradecylammonium, 2,4-D-triethylammonium, 2,4-D-tris(2-hydroxypropyl)ammonium, 2,4-D-tris(isopropyl)ammonium, 2,4-D-trolamine, 2,4-D-lithium, 2,4-D-sodium. Examples of suitable esters of 2,4-D are 2,4-D-butotyl, 2,4-D-2-butoxypropyl, 2,4-D-3-butoxypropyl, 2,4-D-butyl, 2,4-D-ethyl, 2,4-D-ethylhexyl, 2,4-D-isobutyl, 2,4-D-isooctyl, 2,4-D-isopropyl, 2,4-D-meptyl, 2,4-D-methyl, 2,4-D-octyl, 2,4-D-pentyl, 2,4-D-propyl, 2,4-D-tefuryl and clacyfos.

Suitable salts of 2,4-DB are for example 2,4-DB-sodium, 2,4-DB-potassium and 2,4-DB-dimethylammonium. Suitable esters of 2,4-DB are for example 2,4-DB-butyl and 2,4-DB-isoctyl. Suitable salts of dichlorprop are for example dichlorprop-sodium, dichlorprop-potassium and dichlorprop-dimethylammonium. Examples of suitable esters of dichlorprop are dichlorprop-butotyl and dichlorprop-isoctyl.

Suitable salts and esters of MCPA include MCPA-butotyl, MCPA-butyl, MCPA-dimethylammonium, MCPA-diolamine, MCPA-ethyl, MCPA-thioethyl, MCPA-2-ethylhexyl, MCPA-isobutyl, MCPA-isoctyl, MCPA-isopropyl, MCPA-isopropylammonium, MCPA-methyl, MCPA-olamine, MCPA-potassium, MCPA-sodium and MCPA-trolamine.

A suitable salt of MCPB is MCPB sodium. A suitable ester of MCPB is MCPB-ethyl. Suitable salts of clopyralid are clopyralid-potassium, clopyralid-olamine and clopyralid-tris-(2-hydroxypropyl)ammonium. Example of suitable esters of clopyralid is clopyralid-methyl. Examples of a suitable ester of fluroxypyr are fluroxypyr-meptyl and fluroxypyr-2-butoxy-1-methylethyl, wherein fluroxypyr-meptyl is preferred.

Suitable salts of picloram are picloram-dimethylammonium, picloram-potassium, picloram-triisopropanolammonium, picloram-triisopropylammonium and picloram-trolamine. A suitable ester of picloram is picloram-isoctyl.

A suitable salt of triclopyr is triclopyr-triethylammonium. Suitable esters of triclopyr are for example triclopyr-ethyl and triclopyr-butotyl.

Suitable salts and esters of chloramben include chloramben-ammonium, chloramben-diolamine, chloramben-methyl, chloramben-methylammonium and chloramben-sodium. Suitable salts and esters of 2,3,6-TBA include 2,3,6-TBA-dimethylammonium, 2,3,6-TBA-lithium, 2,3,6-TBA-potassium and 2,3,6-TBA-sodium.

Suitable salts and esters of aminopyralid include aminopyralid-potassium, aminopyralid-dimethylammonium, and aminopyralid-tris(2-hydroxypropyl)ammonium.

Suitable salts of glyphosate are for example glyphosate-ammonium, glyphosate-diammonium, glyphoste-dimethylammonium, glyphosate-isopropylammonium, glyphosate-potassium, glyphosate-sodium, glyphosate-trimesium as well as the ethanolamine and diethanolamine salts, preferably glyphosate-diammonium, glyphosate-isopropylammonium and glyphosate-trimesium (sulfosate).

A suitable salt of glufosinate is for example glufosinate-ammonium.

A suitable salt of glufosinate-P is for example glufosinate-P-ammonium.

Suitable salts and esters of bromoxynil are for example bromoxynil-butyrate, bromoxynil-heptanoate, bromoxynil-octanoate, bromoxynil-potassium and bromoxynil-sodium.

Suitable salts and esters of ioxonil are for example ioxonil-octanoate, ioxonil-potassium and ioxonil-sodium.

Suitable salts and esters of mecoprop include mecoprop-butotyl, mecoprop-dimethylammonium, mecoprop-diolamine, mecoprop-ethadyl, mecoprop-2-ethylhexyl, mecoprop-isoctyl, mecoprop-methyl, mecoprop-potassium, mecoprop-sodium and mecoprop-trolamine.

Suitable salts of mecoprop-P are for example mecoprop-P-butotyl, mecoprop-P-dimethylammonium, mecoprop-P-2-ethylhexyl, mecoprop-P-isobutyl, mecoprop-P-potassium and mecoprop-P-sodium.

A suitable salt of diflufenzopyr is for example diflufenzopyr-sodium.

A suitable salt of naptalam is for example naptalam-sodium.

Suitable salts and esters of aminocyclopyrachlor are for example aminocyclopyrachlor-dimethylammonium, aminocyclopyrachlor-methyl, aminocyclopyrachlor-triisopropanolammonium, aminocyclopyrachlor-sodium and aminocyclopyrachlor-potassium.

A suitable salt of quinclorac is for example quinclorac-dimethylammonium.

A suitable salt of quinmerac is for example quinmerac-dimethylammonium.

A suitable salt of imazamox is for example imazamox-ammonium.

Suitable salts of imazapic are for example imazapic-ammonium and imazapic-isopropylammonium.

Suitable salts of imazapyr are for example imazapyr-ammonium and imazapyr-isopropylammonium.

A suitable salt of imazaquin is for example imazaquin-ammonium.

Suitable salts of imazethapyr are for example imazethapyr-ammonium and imazethapyr-isopropylammonium.

A suitable salt of topramezone is for example topramezone-sodium.

Particularly preferred herbicides Bare the herbicides Bas defined above; in particular the herbicides B.1-B.202, especially the herbicides B.1-B.201 listed below in table B:

TABLE B

| | Herbicide B |
|---|---|
| A. 1 | clethodim |
| A. 2 | clodinafop-propargyl |
| A. 3 | cycloxydim |
| A. 4 | cyhalofop-butyl |
| A. 5 | fenoxaprop-ethyl |
| A. 6 | fenoxaprop-P-ethyl |
| A. 7 | metamifop |
| A. 8 | pinoxaden |
| A. 9 | profoxydim |
| A. 10 | sethoxydim |
| A. 11 | tepraloxydim |
| A. 12 | tralkoxydim |
| A. 13 | esprocarb |
| A. 14 | ethofumesate |
| A. 15 | molinate |
| A. 16 | prosulfocarb |
| A. 17 | thiobencarb |
| A. 18 | triallate |
| A. 19 | bensulfuron-methyl |
| A. 20 | bispyribac-sodium |
| A. 21 | cloransulam-methyl |
| A. 22 | chlorsulfuron |
| A. 23 | clorimuron |
| A. 24 | cyclosulfamuron |
| A. 25 | diclosulam |
| A. 26 | florasulam |
| A. 27 | flumetsulam |
| A. 28 | flupyrsulfuron-methyl-sodium |
| A. 29 | foramsulfuron |
| A. 30 | imazamox |
| A. 31 | imazamox-ammonium |
| A. 32 | imazapic |
| A. 33 | imazapic-ammonium |
| A. 34 | imazapic-isopropylammonium |
| A. 35 | imazapyr |
| A. 36 | imazapyr-ammonium |
| A. 37 | imazapyr-isopropylammonium |
| A. 38 | imazaquin |
| A. 39 | imazaquin-ammonium |
| A. 40 | imazethapyr |
| A. 41 | imazethapyr-ammonium |
| A. 42 | imazethapyr-isopropylammonium |
| A. 43 | imazosulfuron |
| A. 44 | iodosulfuron-methyl-sodium |
| A. 45 | iofensulfuron |
| A. 46 | iofensulfuron-sodium |
| A. 47 | mesosulfuron-methyl |
| A. 48 | metazosulfuron |
| A. 49 | metsulfuron-methyl |
| A. 50 | metosulam |
| A. 51 | nicosulfuron |
| A. 52 | penoxsulam |

TABLE B-continued

| | Herbicide B |
|---|---|
| A. 53 | propoxycarbazon-sodium |
| A. 54 | pyrazosulfuron-ethyl |
| A. 55 | pyribenzoxim |
| A. 56 | pyriftalid |
| A. 57 | pyroxsulam |
| A. 58 | propyrisulfuron |
| A. 59 | rimsulfuron |
| A. 60 | sulfosulfuron |
| A. 61 | thiencarbazone-methyl |
| A. 62 | thifensulfuron-methyl |
| A. 63 | tribenuron-methyl |
| A. 64 | tritosulfuron |
| A. 65 | triafamone |
| A. 66 | ametryne |
| A. 67 | atrazine |
| A. 68 | bentazon |
| A. 69 | bromoxynil |
| A. 70 | bromoxynil-octanoate |
| A. 71 | bromoxynil-heptanoate |
| A. 72 | bromoxynil-potassium |
| A. 73 | diuron |
| A. 74 | fluometuron |
| A. 75 | hexazinone |
| A. 76 | isoproturon |
| A. 77 | linuron |
| A. 78 | metamitron |
| A. 79 | metribuzin |
| A. 80 | propanil |
| A. 81 | simazin |
| A. 82 | terbuthylazine |
| A. 83 | terbutryn |
| A. 84 | paraquat-dichloride |
| A. 85 | acifluorfen |
| A. 86 | butafenacil |
| A. 87 | carfentrazone-ethyl |
| A. 88 | flumioxazin |
| A. 89 | fomesafen |
| A. 90 | oxadiargyl |
| A. 91 | oxyfluorfen |
| A. 92 | pyraflufen |
| A. 93 | pyraflufen-ethyl |
| A. 94 | saflufenacil |
| A. 95 | sulfentrazone |
| A. 96 | trifludimoxazin |
| A. 97 | ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6 |
| A. 98 | benzobicyclon |
| A. 99 | bicyclopyrone |
| A. 100 | clomazone |
| A. 101 | diflufenican |
| A. 102 | flurochloridone |
| A. 103 | isoxaflutole |
| A. 104 | mesotrione |
| A. 105 | norflurazone |
| A. 106 | picolinafen |
| A. 107 | sulcotrione |
| A. 108 | tefuryltrione |
| A. 109 | tembotrione |
| A. 110 | tolpyralate |
| A. 111 | topramezone |
| A. 112 | topramezone-sodium |
| A. 113 | amitrole |
| A. 114 | fluometuron |
| A. 115 | fenquinotrione |
| A. 116 | glyphosate |
| A. 117 | glyphosate-ammonium |
| A. 118 | glyphosate-dimethylammonium |
| A. 119 | glyphosate-isopropylammonium |
| A. 120 | glyphosate-trimesium (sulfosate) |
| A. 121 | glyphosate-potassium |
| A. 122 | glufosinate |
| A. 123 | glufosinate-ammonium |
| A. 124 | glufosinate-P |
| A. 125 | glufosinate-P-ammonium |
| A. 126 | pendimethalin |
| A. 127 | trifluralin |
| A. 128 | acetochlor |
| A. 129 | butachlor |
| A. 130 | cafenstrole |
| A. 131 | dimethenamid-P |
| A. 132 | fentrazamide |
| A. 133 | flufenacet |
| A. 134 | mefenacet |
| A. 135 | metazachlor |
| A. 136 | metolachlor |
| A. 137 | S-metolachlor |
| A. 138 | pretilachlor |
| A. 139 | fenoxasulfone |
| A. 140 | indaziflam |
| A. 141 | isoxaben |
| A. 142 | triaziflam |
| A. 143 | ipfencarbazone |
| A. 144 | pyroxasulfone |
| A. 145 | 2,4-D |
| A. 146 | 2,4-D-isobutyl |
| A. 147 | 2,4-D-dimethylammonium |
| A. 148 | 2,4-D-N,N,N-trimethylethanolammonium |
| A. 149 | aminopyralid |
| A. 150 | aminopyralid-methyl |
| A. 151 | aminopyralid-dimethyl-ammonium |
| A. 152 | aminopyralid-tris(2-hydroxypropyl)ammonium |
| A. 153 | clopyralid |
| A. 154 | clopyralid-methyl |
| A. 155 | clopyralid-olamine |
| A. 156 | dicamba |
| A. 157 | dicamba-butotyl |
| A. 158 | dicamba-diglycolamine |
| A. 159 | dicamba-dimethylammonium |
| A. 160 | dicamba-diolamine |
| A. 161 | dicamba-isopropylammonium |
| A. 162 | dicamba-potassium |
| A. 163 | dicamba-sodium |
| A. 164 | dicamba-trolamine |
| A. 165 | dicamba-N,N-bis-(3-aminopropyl)methylamine |
| A. 166 | dicamba-diethylenetriamine |
| A. 167 | fluroxypyr |
| A. 168 | fluroxypyr-meptyl |
| A. 169 | halauxifen |
| A. 170 | halauxifen-methyl |
| A. 171 | MCPA |
| A. 172 | MCPA-2-ethylhexyl |
| A. 173 | MCPA-dimethylammonium |
| A. 174 | quinclorac |
| A. 175 | quinclorac-dimethylammonium |
| A. 176 | quinmerac |
| A. 177 | quinmerac-dimethylammonium |
| A. 178 | florpyrauxifen |
| A. 179 | florpyrauxifen-benzyl (CAS 1390661-72-9) |
| A. 180 | aminocyclopyrachlor |
| A. 181 | aminocyclopyrachlor-potassium |
| A. 182 | aminocyclopyrachlor-methyl |
| A. 183 | diflufenzopyr |
| A. 184 | diflufenzopyr-sodium |
| A. 185 | dymron |
| A. 186 | indanofan |
| A. 187 | oxaziclomefone |

TABLE B-continued

| | Herbicide B |
|---|---|
| A. 188 | II.1 |
| A. 189 | II.2 |
| A. 190 | II.3 |
| A. 191 | II.4 |
| A. 192 | II.5 |
| A. 193 | II.6 |
| A. 194 | II.7 |
| A. 195 | II.8 |
| A. 196 | II.9 |
| A. 197 | 4-amino-3-chloro-5-fluoro-6-(7-fluoro-1H-indol-6-yl)picolinic acid (CAS 1629965-65-6) |
| A. 198 | flopyrauxifen |
| A. 199 | oxotrione (CAS 1486617-21-3) |
| A. 200 | cinmethylin |
| A. 201 | 2-chloro-3-methylsulfanyl-N-(1-methyltetrazol-5-yl)-4-(trifluoromethyl)benzamide (CAS 1361139-71-0) |
| A. 202 | 2-(2,4-dichlorophenyl)-methyl-4,4-dimethyl-3-isoxazolidone (CAS 81777-95-9) |

Moreover, it may be useful to apply the uracilpyridines of formula (I) in combination with safeners. Safeners are chemical compounds which prevent or reduce damage on useful plants without having a major impact on the herbicidal action of the uracilpyridines of formula (I) towards unwanted plants. They can be applied either before sowings (e.g. on seed treatments, shoots or seedlings) or in the pre-emergence application or post-emergence application of the useful plant. The safeners and the uracilpyridines of formula (I) and optionally the herbicides B can be applied simultaneously or in succession.

In another embodiment of the present invention the compositions according to the present invention comprise at least one uracilpyridine of formula (I) and at least one safener C (component C).

Suitable safeners are e.g. (quinolin-8-oxy)acetic acids, 1-phenyl-5-haloalkyl-1H-1,2,4-triazol-3-carboxylic acids, 1-phenyl-4,5-dihydro-5-alkyl-1H-pyrazol-3,5-dicarboxylic acids, 4,5-dihydro-5,5-diaryl-3-isoxazol carboxylic acids, dichloroacetamides, alpha-oximinophenylacetonitriles, acetophenonoximes, 4,6-dihalo-2-phenylpyrimidines, N-[[4-(aminocarbonyl)phenyl]sulfonyl]-2-benzoic amides, 1,8-naphthalic anhydride, 2-halo-4-(haloalkyl)-5-thiazol carboxylic acids, phosphorthiolates and N-alkyl-O-phenyl-carbamates and their agriculturally acceptable salts and their agriculturally acceptable derivatives such amides, esters, and thioesters, provided they have an acid group.

Examples of preferred safeners C are benoxacor, cloquintocet, cyometrinil, cyprosulfamide, dichlormid, dicyclonon, dietholate, fenchlorazole, fenclorim, flurazole, fluxofenim, furilazole, isoxadifen, mefenpyr, mephenate, naphthalic anhydride, oxabetrinil, 4-(dichloroacetyl)-1-oxa-4-azaspiro[4.5]decane (MON4660, CAS 71526-07-3), 2,2,5-trimethyl-3-(dichloroacetyl)-1,3-oxazolidine (R-29148, CAS 52836-31-4), metcamifen and BPCMS (CAS 54091-06-4);

especially preferred benoxacor, cloquintocet, cyometrinil, cyprosulfamide, dichlormid, dicyclonon, dietholate, fenchlorazole, fenclorim, flurazole, fluxofenim, furilazole, isoxadifen, mefenpyr, mephenate, naphthalic anhydride, oxabetrinil, 4-(dichloroacetyl)-1-oxa-4-azaspiro[4.5]decane (MON4660, CAS 71526-07-3), 2,2,5-trimethyl-3-(dichloroacetyl)-1,3-oxazolidine (R-29148, CAS 52836-31-4) and metcamifen.

Particularly preferred safeners C, which, as component C, are constituent of the composition according to the invention are the safeners C as defined above; in particular the safeners C.1-C.17 listed below in table C:

TABLE C

| | Safener C |
|---|---|
| C. 1 | benoxacor |
| C. 2 | cloquintocet |
| C. 3 | cloquintocet-mexyl |
| C. 4 | cyprosulfamide |
| C. 5 | dichlormid |
| C. 6 | fenchlorazole |
| C. 7 | fenchlorazole-ethyl |
| C. 8 | fenclorim |
| C. 9 | furilazole |
| C. 10 | isoxadifen |
| C. 11 | isoxadifen-ethyl |
| C. 12 | mefenpyr |
| C. 13 | mefenpyr-diethyl |
| C. 14 | naphtalic acid anhydride |
| C. 15 | 4-(dichloroacetyl)-1-oxa-4-azaspiro[4.5]decane (CAS 71526-07-3) |
| C. 16 | 2,2,5-trimethyl-3-(dichloroacetyl)-1,3-oxazolidine (CAS 52836-31-4) |
| C. 17 | metcamifen |

The active compounds B of groups b1) to b15) and the active compounds C are known herbicides and safeners, see, for example, The Compendium of Pesticide Common Names (http://www.alanwood.net/pesticides/); Farm Chemicals Handbook 2000 volume 86, Meister Publishing Company, 2000; B. Hock, C. Fedtke, R. R. Schmidt, Herbizide [Herbicides], Georg Thieme Verlag, Stuttgart 1995; W. H. Ahrens, Herbicide Handbook, 7th edition, Weed Science Society of America, 1994; and K. K. Hatzios, Herbicide Handbook, Supplement for the 7th edition, Weed Science Society of America, 1998. 2,2,5-Trimethyl-3-(dichloroacetyl)-1,3-oxazolidine [CAS No. 52836-31-4] is also referred to as R-29148. 4-(Dichloroacetyl)-1-oxa-4-azaspiro [4.5]decane [CAS No. 71526-07-3] is also referred to as AD-67 and MON 4660.

The assignment of the active compounds to the respective mechanisms of action is based on current knowledge. If several mechanisms of action apply to one active compound, this substance was only assigned to one mechanism of action.

According to a preferred embodiment of the invention, the composition comprises as herbicidal active compound B or component B at least one, preferably exactly one herbicide B.

According to another preferred embodiment of the invention, the composition comprises as herbicidal active compounds B or component B at least two, preferably exactly two herbicides B different from each other.

According to another preferred embodiment of the invention, the composition comprises as herbicidal active compounds B or component B at least three, preferably exactly three herbicides B different from each other.

According to another preferred embodiment of the invention, the composition comprises as herbicidal active compounds B or component B at least four, preferably exactly four herbicides B different from each other.

According to another preferred embodiment of the invention, the composition comprises as safening component C or component C at least one, preferably exactly one safener C.

According to another preferred embodiment of the invention, the composition comprises as component B at least one, preferably exactly one herbicide B, and as component C at least one, preferably exactly one, safener C.

According to another preferred embodiment of the invention, the composition comprises at least two, preferably exactly two, herbicides B different from each other, and as component C at least one, preferably exactly one, safener C.

According to another preferred embodiment of the invention, the composition comprises at least three, preferably exactly three, herbicides B different from each other, and as component C at least one, preferably exactly one, safener C.

According to another preferred embodiment of the invention, the composition comprises as component A at least one, preferably exactly one compound of formula (I), preferably of formula (I.a) or (I.h), and as component B at least one, preferably exactly one, herbicide B.

According to another preferred embodiment of the invention, the composition comprises as component A at least one, preferably exactly one compound of formula (I), preferably of formula (I.a) or (I.h), and at least two, preferably exactly two, herbicides B different from each other.

According to another preferred embodiment of the invention, the composition comprises as component A at least one, preferably exactly one compound of formula (I), preferably of formula (I.a) or (I.h), and at least three, preferably exactly three, herbicides B different from each other.

According to another preferred embodiment of the invention, the composition comprises as component A at least one, preferably exactly one compound of formula (I), preferably of formula (I.a) or (I.h), and at least four, preferably exactly four, herbicides B different from each other.

According to another preferred embodiment of the invention, the composition comprises as component A at least one, preferably exactly one compound of formula (I), preferably of formula (I.a) or (I.h), and as component C at least one, preferably exactly one, safener C.

According to another preferred embodiment of the invention, the composition comprises as component A at least one, preferably exactly one compound of formula (I), preferably of formula (I.a) or (I.h), as component B at least one, preferably exactly one, herbicide B, and as component C at least one, preferably exactly one safener C.

According to another preferred embodiment of the invention, the composition comprises as component A at least one, preferably exactly one compound of formula (I), preferably of formula (I.a) or (I.h), at least two, preferably exactly two herbicides B different from each other, and as component C at least one, preferably exactly one, safener C.

According to another preferred embodiment of the invention, the composition comprises as component A at least one, preferably exactly one compound of formula (I), preferably of formula (I.a) or (I.h), at least three, preferably exactly three herbicides B different from each other, and as component C at least one, preferably exactly one, safener C.

According to another preferred embodiment of the invention, the composition comprises, in addition to an uracilpyridine of formula (a), especially an active compound from the group consisting of (I.a.87), (I.a.109), (I.a.115), (I.a.255), (I.a.277), (I.a.283), (I.a.339), (I.a.361), (I.a.367), (I.h.87), (I.h.109), (I.h.115), (I.h.255), (I.h.277), (I.h.283), (I.h.339), (I.h.361) and (I.h.367), at least one and especially exactly one herbicidally active compound from group b4), in particular selected from the group consisting of acifluorfen, butafencil, carfenetrazone-ethyl, flumioxazin, fomesafen, oxadiargyl, oxyfluorfen, pyraflufen, pyraflufen-ethyl, saflufenacil, sulfentrazone, trifludimoxazin, ethyl [3-[2-chloro-4-fluoro-5-(1-methyl-6-trifluoromethyl-2,4-dioxo-1,2,3,4-tetrahydropyrimidin-3-yl)phenoxy]-2-pyridloxy]acetate (CAS 353292-31-6). According to another preferred embodiment of the invention, the composition comprises, in addition to an uracilpyridine of formula (I), especially an active compound from the group consisting of (I.a.87), (I.a.109), (I.a.115), (I.a.255), (I.a.277), (I.a.283), (I.a.339), (I.a.361), (I.a.367), (I.h.87), (I.h.109), (I.h.115), (I.h.255), (I.h.277), (I.h.283), (I.h.339), (I.h.361) and (I.h.367), at least one and especially exactly one herbicidally active compound from group b6), in particular selected from the group consisting of glyphosate, glyphosate-ammonium, glyphosate-dimethylammonium, glyphosate-isopropylammonium and glyphosate-trimesium (sulfosate) and glyphosate-potassium.

According to another preferred embodiment of the invention, the composition comprises, in addition to an uracilpyridine of formula (I), especially an active compound from the group consisting of (I.a.87), (I.a.109), (I.a.115), (I.a.255), (I.a.277), (I.a.283), (I.a.339), (I.a.361), (I.a.367), (I.h.87), (I.h.109), (I.h.115), (I.h.255), (I.h.277), (I.h.283), (I.h.339), (I.h.361) and (I.h.367), at least one and especially exactly one herbicidally active compound from group b10), in particular selected from the group consisting of acetochlor, butachlor, cafenstrole, dimethenamid-P, fentrazamide, flufenacet, mefenacet, metazachlor, metolachlor, S-metolachlor, fenoxasulfone, ipfencarbazone and pyroxasulfone. Likewise, preference is given to compositions comprising in addition to an uracilpyridine of formula (I), especially an active compound from the group consisting of (I.a.87), (I.a.109), (I.a.115), (I.a.255), (I.a.277), (I.a.283), (I.a.339), (I.a.361), (I.a.367), (I.h.87), (I.h.109), (I.h.115), (I.h.255), (I.h.277), (I.h.283), (I.h.339), (I.h.361) and (I.h.367), at least one and especially exactly one herbicidally active compound from group b10), in particular selected from the group consisting of isoxazoline compounds of the formulae II.1, II.2, II.3, II.4, II.5, II.6, II.7, II.8 and II.9, as defined above.

According to another preferred embodiment of the invention, the composition comprises, in addition to an uracilpyridine of formula (I), especially an active compound from the group consisting of (I.a.87), (I.a.109), (I.a.115), (I.a.255), (I.a.277), (I.a.283), (I.a.339), (I.a.361), (I.a.367), (I.h.87), (I.h.109), (I.h.115), (I.h.255), (I.h.277), (I.h.283), (I.h.339), (I.h.361) and (I.h.367), at least one and especially exactly one herbicidally active compound from group b13), in particular selected from the group consisting of 2,4-D, 2,4-D-isobutyl, 2,4-D-dimethylammonium, 2,4-D-N,N,N-trimethylethanolammonium, aminocyclopyrachlor, aminocyclopyrachlor-potassium, aminocyclopyrachlor-methyl, aminopyralid, aminopyralid-methyl, aminopyralid-dimethylammonium, aminopyralid-tris(2-hydroxypropyl)ammonium, clopyralid, clopyralid-methyl, clopyralid-olamine, dicamba, dicamba-butotyl, dicamba-diglycolamine, dicamba-dimethylammonium, dicamba-diolamine, dicamba-isopropylammonium, dicamba-potassium, dicamba-sodium, dicamba-trolamine, dicamba-N,N-bis-(3-aminopropyl)methylamine, dicamba-diethylenetriamine, flopyrauxifen, fluroxypyr, fluroxypyr-meptyl, halauxifen, halauxifen-methyl, MCPA, MCPA-2-ethylhexyl, MCPA-dimethylammonium, quinclorac, quinclorac-dimethylammonium, quinmerac, quinmerac-dimethylammonium, florpyrauxifen, florpyrauxifen-benzyl (CAS 1390661-72-9), and 4-amino-3-chloro-5-fluoro-6-(7-fluoro-1H-indol-6-yl)picolinic acid.

Here and below, the term "binary compositions" includes compositions comprising one or more, for example 1, 2 or 3, active compounds of the formula (I) and either one or more, for example 1, 2 or 3, herbicides B or one or more safeners C.

Correspondingly, the term "ternary compositions" includes compositions comprising one or more, for example 1, 2 or 3, active compounds of the formula (I), one or more, for example 1, 2 or 3, herbicides B and one or more, for example 1, 2 or 3, safeners C.

In binary compositions comprising at least one compound of the formula (I) as component A and at least one herbicide B, the weight ratio of the active compounds A:B is generally in the range of from 1:1000 to 1000:1, preferably in the range of from 1:500 to 500:1, in particular in the range of from 1:250 to 250:1 and particularly preferably in the range of from 1:125 to 125:1.

In binary compositions comprising at least one compound of the formula (I) as component A and at least one safener C, the weight ratio of the active compounds A:C is generally in the range of from 1:1000 to 1000:1, preferably in the range of from 1:500 to 500:1, in particular in the range of from 1:250 to 250:1 and particularly preferably in the range of from 1:75 to 75:1.

In ternary compositions comprising at least one uracilpyridine of formula (I) as component A, at least one herbicide B and at least one safener C, the relative proportions by weight of the components A:B are generally in the range of from 1:1000 to 1000:1, preferably in the range of from 1:500 to 500:1, in particular in the range of from 1:250 to 250:1 and particularly preferably in the range of from 1:125 to 125:1, the weight ratio of the components A:C is generally in the range of from 1:1000 to 1000:1, preferably in the range of from 1:500 to 500:1, in particular in the range of from 1:250 to 250:1 and particularly preferably in the range of from 1:75 to 75:1, and the weight ratio of the components B:C is generally in the range of from 1:1000 to 1000:1, preferably in the range of from 1:500 to 500:1, in particular in the range of from 1:250 to 250:1 and particularly preferably in the range of from 1:75 to 75:1. The weight ratio of components A+B to component C is preferably in the range of from 1:500 to 500:1, in particular in the range of from 1:250 to 250:1 and particularly preferably in the range of from 1:75 to 75:1.

The weight ratios of the individual components in the preferred mixtures mentioned below are within the limits given herein, in particular within the preferred limits.

Particularly preferred are the compositions mentioned below comprising the uracilpyridines of formula (as defined and the substance(s) as defined in the respective row of table 1;

especially preferred comprising as only herbicidal active compounds the uracilpyridines of formula (I) as defined and the substance(s) as defined in the respective row of table 1;

most preferably comprising as only active compounds the uracilpyridines of formula (I) as defined and the substance(s) as defined in the respective row of table 1.

Particularly preferred are compositions 1.1 to 1.3653, especially compositions 1.1 to 1.3635, comprising the uracilpyridine (Ia.339) and the substance(s) as defined in the respective row of table 1:

TABLE 1

(compositions 1.1 to 1.3635):

| comp. no. | herbicide B | safener C |
|---|---|---|
| 1.1 | B.1 | — |
| 1.2 | B.2 | — |
| 1.3 | B.3 | — |
| 1.4 | B.4 | — |
| 1.5 | B.5 | — |
| 1.6 | B.6 | — |
| 1.7 | B.7 | — |
| 1.8 | B.8 | — |
| 1.9 | B.9 | — |
| 1.10 | B.10 | — |
| 1.11 | B.11 | — |
| 1.12 | B.12 | — |
| 1.13 | B.13 | — |
| 1.14 | B.14 | — |
| 1.15 | B.15 | — |
| 1.16 | B.16 | — |
| 1.17 | B.17 | — |
| 1.18 | B.18 | — |
| 1.19 | B.19 | — |
| 1.20 | B.20 | — |
| 1.21 | B.21 | — |
| 1.22 | B.22 | — |
| 1.23 | B.23 | — |
| 1.24 | B.24 | — |
| 1.25 | B.25 | — |
| 1.26 | B.26 | — |
| 1.27 | B.27 | — |
| 1.28 | B.28 | — |
| 1.29 | B.29 | — |
| 1.30 | B.30 | — |
| 1.31 | B.31 | — |
| 1.32 | B.32 | — |
| 1.33 | B.33 | — |
| 1.34 | B.34 | — |
| 1.35 | B.35 | — |
| 1.36 | B.36 | — |
| 1.37 | B.37 | — |
| 1.38 | B.38 | — |
| 1.39 | B.39 | — |
| 1.40 | B.40 | — |
| 1.41 | B.41 | — |
| 1.42 | B.42 | — |
| 1.43 | B.43 | — |
| 1.44 | B.44 | — |
| 1.45 | B.45 | — |
| 1.46 | B.46 | — |
| 1.47 | B.47 | — |
| 1.48 | B.48 | — |
| 1.49 | B.49 | — |
| 1.50 | B.50 | — |
| 1.51 | B.51 | — |
| 1.52 | B.52 | — |
| 1.53 | B.53 | — |
| 1.54 | B.54 | — |
| 1.55 | B.55 | — |
| 1.56 | B.56 | — |
| 1.57 | B.57 | — |
| 1.58 | B.58. | — |
| 1.59 | B.59 | — |
| 1.60 | B.60 | — |
| 1.61 | B.61 | — |
| 1.62 | B.62 | — |
| 1.63 | B.63 | — |
| 1.64 | B.64 | — |
| 1.65 | B.65 | — |
| 1.66 | B.66 | — |
| 1.67 | B.67 | — |
| 1.68 | B.68 | — |
| 1.69 | B.69 | — |
| 1.70 | B.70 | — |
| 1.71 | B.71 | — |
| 1.72 | B.72 | — |
| 1.73 | B.73 | — |
| 1.74 | B.74 | — |
| 1.75 | B.75 | — |
| 1.76 | B.76 | — |
| 1.77 | B.77 | — |
| 1.78 | B.78 | — |
| 1.79 | B.79 | — |

TABLE 1-continued (compositions 1.1 to 1.3635):

| comp. no. | herbicide B | safener C |
|---|---|---|
| 1.80 | B.80 | — |
| 1.81 | B.81 | — |
| 1.82 | B.82 | — |
| 1.83 | B.83 | — |
| 1.84 | B.84 | — |
| 1.85 | B.85 | — |
| 1.86 | B.86 | — |
| 1.87 | B.87 | — |
| 1.88 | B.88 | — |
| 1.89 | B.89 | — |
| 1.90 | B.90 | — |
| 1.91 | B.91 | — |
| 1.92 | B.92 | — |
| 1.93 | B.93 | — |
| 1.94 | B.94 | — |
| 1.95 | B.95 | — |
| 1.96 | B.96 | — |
| 1.97 | B.97 | — |
| 1.98 | B.98 | — |
| 1.99 | B.99 | — |
| 1.100 | B.100 | — |
| 1.101 | B.101 | — |
| 1.102 | B.102 | — |
| 1.103 | B.103 | — |
| 1.104 | B.104 | — |
| 1.105 | B.105 | — |
| 1.106 | B.106 | — |
| 1.107 | B.107 | — |
| 1.108 | B.108 | — |
| 1.109 | B.109 | — |
| 1.110 | B.110 | — |
| 1.111 | B.111 | — |
| 1.112 | B.112 | — |
| 1.113 | B.113 | — |
| 1.114 | B.114 | — |
| 1.115 | B.115 | — |
| 1.116 | B.116 | — |
| 1.117 | B.117 | — |
| 1.118 | B.118 | — |
| 1.119 | B.119 | — |
| 1.120 | B.120 | — |
| 1.121 | B.121 | — |
| 1.122 | B.122 | — |
| 1.123 | B.123 | — |
| 1.124 | B.124 | — |
| 1.125 | B.125 | — |
| 1.126 | B.126 | — |
| 1.127 | B.127 | — |
| 1.128 | B.128 | — |
| 1.129 | B.129 | — |
| 1.130 | B.130 | — |
| 1.131 | B.131 | — |
| 1.132 | B.132 | — |
| 1.133 | B.133 | — |
| 1.134 | B.134 | — |
| 1.135 | B.135 | — |
| 1.136 | B.136 | — |
| 1.137 | B.137 | — |
| 1.138 | B.138 | — |
| 1.139 | B.139 | — |
| 1.140 | B.140 | — |
| 1.141 | B.141 | — |
| 1.142 | B.142 | — |
| 1.143 | B.143 | — |
| 1.144 | B.144 | — |
| 1.145 | B.145 | — |
| 1.146 | B.146 | — |
| 1.147 | B.147 | — |
| 1.148 | B.148 | — |
| 1.149 | B.149 | — |
| 1.150 | B.150 | — |
| 1.151 | B.151 | — |
| 1.152 | B.152 | — |
| 1.153 | B.153 | — |
| 1.154 | B.154 | — |
| 1.155 | B.155 | — |
| 1.156 | B.156 | — |
| 1.157 | B.157 | — |
| 1.158 | B.158 | — |
| 1.159 | B.159 | — |
| 1.160 | B.160 | — |
| 1.161 | B.161 | — |
| 1.162 | B.162 | — |
| 1.163 | B.163 | — |
| 1.164 | B.164 | — |
| 1.165 | B.165 | — |
| 1.166 | B.166 | — |
| 1.167 | B.167 | — |
| 1.168 | B.168 | — |
| 1.169 | B.169 | — |
| 1.170 | B.170 | — |
| 1.171 | B.171 | — |
| 1.172 | B.172 | — |
| 1.173 | B.173 | — |
| 1.174 | B.174 | — |
| 1.175 | B.175 | — |
| 1.176 | B.176 | — |
| 1.177 | B.177 | — |
| 1.178 | B.178 | — |
| 1.179 | B.179 | — |
| 1.180 | B.180 | — |
| 1.181 | B.181 | — |
| 1.182 | B.182 | — |
| 1.183 | B.183 | — |
| 1.184 | B.184 | — |
| 1.185 | B.185 | — |
| 1.186 | B.186 | — |
| 1.187 | B.187 | — |
| 1.188 | B.188 | — |
| 1.189 | B.189 | — |
| 1.190 | B.190 | — |
| 1.191 | B.191 | — |
| 1.192 | B.192 | — |
| 1.193 | B.193 | — |
| 1.194 | B.194 | — |
| 1.195 | B.195 | — |
| 1.196 | B.196 | — |
| 1.197 | B.197 | — |
| 1.198 | B.198 | — |
| 1.199 | B.199 | — |
| 1.200 | B.200 | — |
| 1.201 | B.201 | — |
| 1.202 | B.1 | C.1 |
| 1.203 | B.2 | C.1 |
| 1.204 | B.3 | C.1 |
| 1.205 | B.4 | C.1 |
| 1.206 | B.5 | C.1 |
| 1.207 | B.6 | C.1 |
| 1.208 | B.7 | C.1 |
| 1.209 | B.8 | C.1 |
| 1.210 | B.9 | C.1 |
| 1.211 | B.10 | C.1 |
| 1.212 | B.11 | C.1 |
| 1.213 | B.12 | C.1 |
| 1.214 | B.13 | C.1 |
| 1.215 | B.14 | C.1 |
| 1.216 | B.15 | C.1 |
| 1.217 | B.16 | C.1 |
| 1.218 | B.17 | C.1 |
| 1.219 | B.18 | C.1 |
| 1.220 | B.19 | C.1 |
| 1.221 | B.20 | C.1 |
| 1.222 | B.21 | C.1 |
| 1.223 | B.22 | C.1 |
| 1.224 | B.23 | C.1 |
| 1.225 | B.24 | C.1 |
| 1.226 | B.25 | C.1 |
| 1.227 | B.26 | C.1 |
| 1.228 | B.27 | C.1 |
| 1.229 | B.28 | C.1 |

TABLE 1-continued (compositions 1.1 to 1.3635):

| comp. no. | herbicide B | safener C |
|---|---|---|
| 1.230 | B.29 | C.1 |
| 1.231 | B.30 | C.1 |
| 1.232 | B.31 | C.1 |
| 1.233 | B.32 | C.1 |
| 1.234 | B.33 | C.1 |
| 1.235 | B.34 | C.1 |
| 1.236 | B.35 | C.1 |
| 1.237 | B.36 | C.1 |
| 1.238 | B.37 | C.1 |
| 1.239 | B.38 | C.1 |
| 1.240 | B.39 | C.1 |
| 1.241 | B.40 | C.1 |
| 1.242 | B.41 | C.1 |
| 1.243 | B.42 | C.1 |
| 1.244 | B.43 | C.1 |
| 1.245 | B.44 | C.1 |
| 1.246 | B.45 | C.1 |
| 1.247 | B.46 | C.1 |
| 1.248 | B.47 | C.1 |
| 1.249 | B.48 | C.1 |
| 1.250 | B.49 | C.1 |
| 1.251 | B.50 | C.1 |
| 1.252 | B.51 | C.1 |
| 1.253 | B.52 | C.1 |
| 1.254 | B.53 | C.1 |
| 1.255 | B.54 | C.1 |
| 1.256 | B.55 | C.1 |
| 1.257 | B.56 | C.1 |
| 1.258 | B.57 | C.1 |
| 1.259 | B.58. | C.1 |
| 1.260 | B.59 | C.1 |
| 1.261 | B.60 | C.1 |
| 1.262 | B.61 | C.1 |
| 1.263 | B.62 | C.1 |
| 1.264 | B.63 | C.1 |
| 1.265 | B.64 | C.1 |
| 1.266 | B.65 | C.1 |
| 1.267 | B.66 | C.1 |
| 1.268 | B.67 | C.1 |
| 1.269 | B.68 | C.1 |
| 1.270 | B.69 | C.1 |
| 1.271 | B.70 | C.1 |
| 1.272 | B.71 | C.1 |
| 1.273 | B.72 | C.1 |
| 1.274 | B.73 | C.1 |
| 1.275 | B.74 | C.1 |
| 1.276 | B.75 | C.1 |
| 1.277 | B.76 | C.1 |
| 1.278 | B.77 | C.1 |
| 1.279 | B.78 | C.1 |
| 1.280 | B.79 | C.1 |
| 1.281 | B.80 | C.1 |
| 1.282 | B.81 | C.1 |
| 1.283 | B.82 | C.1 |
| 1.284 | B.83 | C.1 |
| 1.285 | B.84 | C.1 |
| 1.286 | B.85 | C.1 |
| 1.287 | B.86 | C.1 |
| 1.288 | B.87 | C.1 |
| 1.289 | B.88 | C.1 |
| 1.290 | B.89 | C.1 |
| 1.291 | B.90 | C.1 |
| 1.292 | B.91 | C.1 |
| 1.293 | B.92 | C.1 |
| 1.294 | B.93 | C.1 |
| 1.295 | B.94 | C.1 |
| 1.296 | B.95 | C.1 |
| 1.297 | B.96 | C.1 |
| 1.298 | B.97 | C.1 |
| 1.299 | B.98 | C.1 |
| 1.300 | B.99 | C.1 |
| 1.301 | B.100 | C.1 |
| 1.302 | B.101 | C.1 |
| 1.303 | B.102 | C.1 |
| 1.304 | B.103 | C.1 |
| 1.305 | B.104 | C.1 |
| 1.306 | B.105 | C.1 |
| 1.307 | B.106 | C.1 |
| 1.308 | B.107 | C.1 |
| 1.309 | B.108 | C.1 |
| 1.310 | B.109 | C.1 |
| 1.311 | B.110 | C.1 |
| 1.312 | B.111 | C.1 |
| 1.313 | B.112 | C.1 |
| 1.314 | B.113 | C.1 |
| 1.315 | B.114 | C.1 |
| 1.316 | B.115 | C.1 |
| 1.317 | B.116 | C.1 |
| 1.318 | B.117 | C.1 |
| 1.319 | B.118 | C.1 |
| 1.320 | B.119 | C.1 |
| 1.321 | B.120 | C.1 |
| 1.322 | B.121 | C.1 |
| 1.323 | B.122 | C.1 |
| 1.324 | B.123 | C.1 |
| 1.325 | B.124 | C.1 |
| 1.326 | B.125 | C.1 |
| 1.327 | B.126 | C.1 |
| 1.328 | B.127 | C.1 |
| 1.329 | B.128 | C.1 |
| 1.330 | B.129 | C.1 |
| 1.331 | B.130 | C.1 |
| 1.332 | B.131 | C.1 |
| 1.333 | B.132 | C.1 |
| 1.334 | B.133 | C.1 |
| 1.335 | B.134 | C.1 |
| 1.336 | B.135 | C.1 |
| 1.337 | B.136 | C.1 |
| 1.338 | B.137 | C.1 |
| 1.339 | B.138 | C.1 |
| 1.340 | B.139 | C.1 |
| 1.341 | B.140 | C.1 |
| 1.342 | B.141 | C.1 |
| 1.343 | B.142 | C.1 |
| 1.344 | B.143 | C.1 |
| 1.345 | B.144 | C.1 |
| 1.346 | B.145 | C.1 |
| 1.347 | B.146 | C.1 |
| 1.348 | B.147 | C.1 |
| 1.349 | B.148 | C.1 |
| 1.350 | B.149 | C.1 |
| 1.351 | B.150 | C.1 |
| 1.352 | B.151 | C.1 |
| 1.353 | B.152 | C.1 |
| 1.354 | B.153 | C.1 |
| 1.355 | B.154 | C.1 |
| 1.356 | B.155 | C.1 |
| 1.357 | B.156 | C.1 |
| 1.358 | B.157 | C.1 |
| 1.359 | B.158 | C.1 |
| 1.360 | B.159 | C.1 |
| 1.361 | B.160 | C.1 |
| 1.362 | B.161 | C.1 |
| 1.363 | B.162 | C.1 |
| 1.364 | B.163 | C.1 |
| 1.365 | B.164 | C.1 |
| 1.366 | B.165 | C.1 |
| 1.367 | B.166 | C.1 |
| 1.368 | B.167 | C.1 |
| 1.369 | B.168 | C.1 |
| 1.370 | B.169 | C.1 |
| 1.371 | B.170 | C.1 |
| 1.372 | B.171 | C.1 |
| 1.373 | B.172 | C.1 |
| 1.374 | B.173 | C.1 |
| 1.375 | B.174 | C.1 |
| 1.376 | B.175 | C.1 |
| 1.377 | B.176 | C.1 |
| 1.378 | B.177 | C.1 |
| 1.379 | B.178 | C.1 |

TABLE 1-continued (compositions 1.1 to 1.3635):

| comp. no. | herbicide B | safener C |
|---|---|---|
| 1.380 | B.179 | C.1 |
| 1.381 | B.180 | C.1 |
| 1.382 | B.181 | C.1 |
| 1.383 | B.182 | C.1 |
| 1.384 | B.183 | C.1 |
| 1.385 | B.184 | C.1 |
| 1.386 | B.185 | C.1 |
| 1.387 | B.186 | C.1 |
| 1.388 | B.187 | C.1 |
| 1.389 | B.188 | C.1 |
| 1.390 | B.189 | C.1 |
| 1.391 | B.190 | C.1 |
| 1.392 | B.191 | C.1 |
| 1.393 | B.192 | C.1 |
| 1.394 | B.193 | C.1 |
| 1.395 | B.194 | C.1 |
| 1.396 | B.195 | C.1 |
| 1.397 | B.196 | C.1 |
| 1.398 | B.197 | C.1 |
| 1.399 | B.198 | C.1 |
| 1.400 | B.199 | C.1 |
| 1.401 | B.200 | C.1 |
| 1.402 | B.201 | C.1 |
| 1.403 | B.1 | C.2 |
| 1.404 | B.2 | C.2 |
| 1.405 | B.3 | C.2 |
| 1.406 | B.4 | C.2 |
| 1.407 | B.5 | C.2 |
| 1.408 | B.6 | C.2 |
| 1.409 | B.7 | C.2 |
| 1.410 | B.8 | C.2 |
| 1.411 | B.9 | C.2 |
| 1.412 | B.10 | C.2 |
| 1.413 | B.11 | C.2 |
| 1.414 | B.12 | C.2 |
| 1.415 | B.13 | C.2 |
| 1.416 | B.14 | C.2 |
| 1.417 | B.15 | C.2 |
| 1.418 | B.16 | C.2 |
| 1.419 | B.17 | C.2 |
| 1.420 | B.18 | C.2 |
| 1.421 | B.19 | C.2 |
| 1.422 | B.20 | C.2 |
| 1.423 | B.21 | C.2 |
| 1.424 | B.22 | C.2 |
| 1.425 | B.23 | C.2 |
| 1.426 | B.24 | C.2 |
| 1.427 | B.25 | C.2 |
| 1.428 | B.26 | C.2 |
| 1.429 | B.27 | C.2 |
| 1.430 | B.28 | C.2 |
| 1.431 | B.29 | C.2 |
| 1.432 | B.30 | C.2 |
| 1.433 | B.31 | C.2 |
| 1.434 | B.32 | C.2 |
| 1.435 | B.33 | C.2 |
| 1.436 | B.34 | C.2 |
| 1.437 | B.35 | C.2 |
| 1.438 | B.36 | C.2 |
| 1.439 | B.37 | C.2 |
| 1.440 | B.38 | C.2 |
| 1.441 | B.39 | C.2 |
| 1.442 | B.40 | C.2 |
| 1.443 | B.41 | C.2 |
| 1.444 | B.42 | C.2 |
| 1.445 | B.43 | C.2 |
| 1.446 | B.44 | C.2 |
| 1.447 | B.45 | C.2 |
| 1.448 | B.46 | C.2 |
| 1.449 | B.47 | C.2 |
| 1.450 | B.48 | C.2 |
| 1.451 | B.49 | C.2 |
| 1.452 | B.50 | C.2 |
| 1.453 | B.51 | C.2 |
| 1.454 | B.52 | C.2 |
| 1.455 | B.53 | C.2 |
| 1.456 | B.54 | C.2 |
| 1.457 | B.55 | C.2 |
| 1.458 | B.56 | C.2 |
| 1.459 | B.57 | C.2 |
| 1.460 | B.58. | C.2 |
| 1.461 | B.59 | C.2 |
| 1.462 | B.60 | C.2 |
| 1.463 | B.61 | C.2 |
| 1.464 | B.62 | C.2 |
| 1.465 | B.63 | C.2 |
| 1.466 | B.64 | C.2 |
| 1.467 | B.65 | C.2 |
| 1.468 | B.66 | C.2 |
| 1.469 | B.67 | C.2 |
| 1.470 | B.68 | C.2 |
| 1.471 | B.69 | C.2 |
| 1.472 | B.70 | C.2 |
| 1.473 | B.71 | C.2 |
| 1.474 | B.72 | C.2 |
| 1.475 | B.73 | C.2 |
| 1.476 | B.74 | C.2 |
| 1.477 | B.75 | C.2 |
| 1.478 | B.76 | C.2 |
| 1.479 | B.77 | C.2 |
| 1.480 | B.78 | C.2 |
| 1.481 | B.79 | C.2 |
| 1.482 | B.80 | C.2 |
| 1.483 | B.81 | C.2 |
| 1.484 | B.82 | C.2 |
| 1.485 | B.83 | C.2 |
| 1.486 | B.84 | C.2 |
| 1.487 | B.85 | C.2 |
| 1.488 | B.86 | C.2 |
| 1.489 | B.87 | C.2 |
| 1.490 | B.88 | C.2 |
| 1.491 | B.89 | C.2 |
| 1.492 | B.90 | C.2 |
| 1.493 | B.91 | C.2 |
| 1.494 | B.92 | C.2 |
| 1.495 | B.93 | C.2 |
| 1.496 | B.94 | C.2 |
| 1.497 | B.95 | C.2 |
| 1.498 | B.96 | C.2 |
| 1.499 | B.97 | C.2 |
| 1.500 | B.98 | C.2 |
| 1.501 | B.99 | C.2 |
| 1.502 | B.100 | C.2 |
| 1.503 | B.101 | C.2 |
| 1.504 | B.102 | C.2 |
| 1.505 | B.103 | C.2 |
| 1.506 | B.104 | C.2 |
| 1.507 | B.105 | C.2 |
| 1.508 | B.106 | C.2 |
| 1.509 | B.107 | C.2 |
| 1.510 | B.108 | C.2 |
| 1.511 | B.109 | C.2 |
| 1.512 | B.110 | C.2 |
| 1.513 | B.111 | C.2 |
| 1.514 | B.112 | C.2 |
| 1.515 | B.113 | C.2 |
| 1.516 | B.114 | C.2 |
| 1.517 | B.115 | C.2 |
| 1.518 | B.116 | C.2 |
| 1.519 | B.117 | C.2 |
| 1.520 | B.118 | C.2 |
| 1.521 | B.119 | C.2 |
| 1.522 | B.120 | C.2 |
| 1.523 | B.121 | C.2 |
| 1.524 | B.122 | C.2 |
| 1.525 | B.123 | C.2 |
| 1.526 | B.124 | C.2 |
| 1.527 | B.125 | C.2 |
| 1.528 | B.126 | C.2 |
| 1.529 | B.127 | C.2 |

TABLE 1-continued (compositions 1.1 to 1.3635):

| comp. no. | herbicide B | safener C |
|---|---|---|
| 1.530 | B.128 | C.2 |
| 1.531 | B.129 | C.2 |
| 1.532 | B.130 | C.2 |
| 1.533 | B.131 | C.2 |
| 1.534 | B.132 | C.2 |
| 1.535 | B.133 | C.2 |
| 1.536 | B.134 | C.2 |
| 1.537 | B.135 | C.2 |
| 1.538 | B.136 | C.2 |
| 1.539 | B.137 | C.2 |
| 1.540 | B.138 | C.2 |
| 1.541 | B.139 | C.2 |
| 1.542 | B.140 | C.2 |
| 1.543 | B.141 | C.2 |
| 1.544 | B.142 | C.2 |
| 1.545 | B.143 | C.2 |
| 1.546 | B.144 | C.2 |
| 1.547 | B.145 | C.2 |
| 1.548 | B.146 | C.2 |
| 1.549 | B.147 | C.2 |
| 1.550 | B.148 | C.2 |
| 1.551 | B.149 | C.2 |
| 1.552 | B.150 | C.2 |
| 1.553 | B.151 | C.2 |
| 1.554 | B.152 | C.2 |
| 1.555 | B.153 | C.2 |
| 1.556 | B.154 | C.2 |
| 1.557 | B.155 | C.2 |
| 1.558 | B.156 | C.2 |
| 1.559 | B.157 | C.2 |
| 1.560 | B.158 | C.2 |
| 1.561 | B.159 | C.2 |
| 1.562 | B.160 | C.2 |
| 1.563 | B.161 | C.2 |
| 1.564 | B.162 | C.2 |
| 1.565 | B.163 | C.2 |
| 1.566 | B.164 | C.2 |
| 1.567 | B.165 | C.2 |
| 1.568 | B.166 | C.2 |
| 1.569 | B.167 | C.2 |
| 1.570 | B.168 | C.2 |
| 1.571 | B.169 | C.2 |
| 1.572 | B.170 | C.2 |
| 1.573 | B.171 | C.2 |
| 1.574 | B.172 | C.2 |
| 1.575 | B.173 | C.2 |
| 1.576 | B.174 | C.2 |
| 1.577 | B.175 | C.2 |
| 1.578 | B.176 | C.2 |
| 1.579 | B.177 | C.2 |
| 1.580 | B.178 | C.2 |
| 1.581 | B.179 | C.2 |
| 1.582 | B.180 | C.2 |
| 1.583 | B.181 | C.2 |
| 1.584 | B.182 | C.2 |
| 1.585 | B.183 | C.2 |
| 1.586 | B.184 | C.2 |
| 1.587 | B.185 | C.2 |
| 1.588 | B.186 | C.2 |
| 1.589 | B.187 | C.2 |
| 1.590 | B.188 | C.2 |
| 1.591 | B.189 | C.2 |
| 1.592 | B.190 | C.2 |
| 1.593 | B.191 | C.2 |
| 1.594 | B.192 | C.2 |
| 1.595 | B.193 | C.2 |
| 1.596 | B.194 | C.2 |
| 1.597 | B.195 | C.2 |
| 1.598 | B.196 | C.2 |
| 1.599 | B.197 | C.2 |
| 1.600 | B.198 | C.2 |
| 1.601 | B.199 | C.2 |
| 1.602 | B.200 | C.2 |
| 1.603 | B.201 | C.2 |
| 1.604 | B.1 | C.3 |
| 1.605 | B.2 | C.3 |
| 1.606 | B.3 | C.3 |
| 1.607 | B.4 | C.3 |
| 1.608 | B.5 | C.3 |
| 1.609 | B.6 | C.3 |
| 1.610 | B.7 | C.3 |
| 1.611 | B.8 | C.3 |
| 1.612 | B.9 | C.3 |
| 1.613 | B.10 | C.3 |
| 1.614 | B.11 | C.3 |
| 1.615 | B.12 | C.3 |
| 1.616 | B.13 | C.3 |
| 1.617 | B.14 | C.3 |
| 1.618 | B.15 | C.3 |
| 1.619 | B.16 | C.3 |
| 1.620 | B.17 | C.3 |
| 1.621 | B.18 | C.3 |
| 1.622 | B.19 | C.3 |
| 1.623 | B.20 | C.3 |
| 1.624 | B.21 | C.3 |
| 1.625 | B.22 | C.3 |
| 1.626 | B.23 | C.3 |
| 1.627 | B.24 | C.3 |
| 1.628 | B.25 | C.3 |
| 1.629 | B.26 | C.3 |
| 1.630 | B.27 | C.3 |
| 1.631 | B.28 | C.3 |
| 1.632 | B.29 | C.3 |
| 1.633 | B.30 | C.3 |
| 1.634 | B.31 | C.3 |
| 1.635 | B.32 | C.3 |
| 1.636 | B.33 | C.3 |
| 1.637 | B.34 | C.3 |
| 1.638 | B.35 | C.3 |
| 1.639 | B.36 | C.3 |
| 1.640 | B.37 | C.3 |
| 1.641 | B.38 | C.3 |
| 1.642 | B.39 | C.3 |
| 1.643 | B.40 | C.3 |
| 1.644 | B.41 | C.3 |
| 1.645 | B.42 | C.3 |
| 1.646 | B.43 | C.3 |
| 1.647 | B.44 | C.3 |
| 1.648 | B.45 | C.3 |
| 1.649 | B.46 | C.3 |
| 1.650 | B.47 | C.3 |
| 1.651 | B.48 | C.3 |
| 1.652 | B.49 | C.3 |
| 1.653 | B.50 | C.3 |
| 1.654 | B.51 | C.3 |
| 1.655 | B.52 | C.3 |
| 1.656 | B.53 | C.3 |
| 1.657 | B.54 | C.3 |
| 1.658 | B.55 | C.3 |
| 1.659 | B.56 | C.3 |
| 1.660 | B.57 | C.3 |
| 1.661 | B.58. | C.3 |
| 1.662 | B.59 | C.3 |
| 1.663 | B.60 | C.3 |
| 1.664 | B.61 | C.3 |
| 1.665 | B.62 | C.3 |
| 1.666 | B.63 | C.3 |
| 1.667 | B.64 | C.3 |
| 1.668 | B.65 | C.3 |
| 1.669 | B.66 | C.3 |
| 1.670 | B.67 | C.3 |
| 1.671 | B.68 | C.3 |
| 1.672 | B.69 | C.3 |
| 1.673 | B.70 | C.3 |
| 1.674 | B.71 | C.3 |
| 1.675 | B.72 | C.3 |
| 1.676 | B.73 | C.3 |
| 1.677 | B.74 | C.3 |
| 1.678 | B.75 | C.3 |
| 1.679 | B.76 | C.3 |

TABLE 1-continued (compositions 1.1 to 1.3635):

| comp. no. | herbicide B | safener C |
|---|---|---|
| 1.680 | B.77 | C.3 |
| 1.681 | B.78 | C.3 |
| 1.682 | B.79 | C.3 |
| 1.683 | B.80 | C.3 |
| 1.684 | B.81 | C.3 |
| 1.685 | B.82 | C.3 |
| 1.686 | B.83 | C.3 |
| 1.687 | B.84 | C.3 |
| 1.688 | B.85 | C.3 |
| 1.689 | B.86 | C.3 |
| 1.690 | B.87 | C.3 |
| 1.691 | B.88 | C.3 |
| 1.692 | B.89 | C.3 |
| 1.693 | B.90 | C.3 |
| 1.694 | B.91 | C.3 |
| 1.695 | B.92 | C.3 |
| 1.696 | B.93 | C.3 |
| 1.697 | B.94 | C.3 |
| 1.698 | B.95 | C.3 |
| 1.699 | B.96 | C.3 |
| 1.700 | B.97 | C.3 |
| 1.701 | B.98 | C.3 |
| 1.702 | B.99 | C.3 |
| 1.703 | B.100 | C.3 |
| 1.704 | B.101 | C.3 |
| 1.705 | B.102 | C.3 |
| 1.706 | B.103 | C.3 |
| 1.707 | B.104 | C.3 |
| 1.708 | B.105 | C.3 |
| 1.709 | B.106 | C.3 |
| 1.710 | B.107 | C.3 |
| 1.711 | B.108 | C.3 |
| 1.712 | B.109 | C.3 |
| 1.713 | B.110 | C.3 |
| 1.714 | B.111 | C.3 |
| 1.715 | B.112 | C.3 |
| 1.716 | B.113 | C.3 |
| 1.717 | B.114 | C.3 |
| 1.718 | B.115 | C.3 |
| 1.719 | B.116 | C.3 |
| 1.720 | B.117 | C.3 |
| 1.721 | B.118 | C.3 |
| 1.722 | B.119 | C.3 |
| 1.723 | B.120 | C.3 |
| 1.724 | B.121 | C.3 |
| 1.725 | B.122 | C.3 |
| 1.726 | B.123 | C.3 |
| 1.727 | B.124 | C.3 |
| 1.728 | B.125 | C.3 |
| 1.729 | B.126 | C.3 |
| 1.730 | B.127 | C.3 |
| 1.731 | B.128 | C.3 |
| 1.732 | B.129 | C.3 |
| 1.733 | B.130 | C.3 |
| 1.734 | B.131 | C.3 |
| 1.735 | B.132 | C.3 |
| 1.736 | B.133 | C.3 |
| 1.737 | B.134 | C.3 |
| 1.738 | B.135 | C.3 |
| 1.739 | B.136 | C.3 |
| 1.740 | B.137 | C.3 |
| 1.741 | B.138 | C.3 |
| 1.742 | B.139 | C.3 |
| 1.743 | B.140 | C.3 |
| 1.744 | B.141 | C.3 |
| 1.745 | B.142 | C.3 |
| 1.746 | B.143 | C.3 |
| 1.747 | B.144 | C.3 |
| 1.748 | B.145 | C.3 |
| 1.749 | B.146 | C.3 |
| 1.750 | B.147 | C.3 |
| 1.751 | B.148 | C.3 |
| 1.752 | B.149 | C.3 |
| 1.753 | B.150 | C.3 |
| 1.754 | B.151 | C.3 |
| 1.755 | B.152 | C.3 |
| 1.756 | B.153 | C.3 |
| 1.757 | B.154 | C.3 |
| 1.758 | B.155 | C.3 |
| 1.759 | B.156 | C.3 |
| 1.760 | B.157 | C.3 |
| 1.761 | B.158 | C.3 |
| 1.762 | B.159 | C.3 |
| 1.763 | B.160 | C.3 |
| 1.764 | B.161 | C.3 |
| 1.765 | B.162 | C.3 |
| 1.766 | B.163 | C.3 |
| 1.767 | B.164 | C.3 |
| 1.768 | B.165 | C.3 |
| 1.769 | B.166 | C.3 |
| 1.770 | B.167 | C.3 |
| 1.771 | B.168 | C.3 |
| 1.772 | B.169 | C.3 |
| 1.773 | B.170 | C.3 |
| 1.774 | B.171 | C.3 |
| 1.775 | B.172 | C.3 |
| 1.776 | B.173 | C.3 |
| 1.777 | B.174 | C.3 |
| 1.778 | B.175 | C.3 |
| 1.779 | B.176 | C.3 |
| 1.780 | B.177 | C.3 |
| 1.781 | B.178 | C.3 |
| 1.782 | B.179 | C.3 |
| 1.783 | B.180 | C.3 |
| 1.784 | B.181 | C.3 |
| 1.785 | B.182 | C.3 |
| 1.786 | B.183 | C.3 |
| 1.787 | B.184 | C.3 |
| 1.788 | B.185 | C.3 |
| 1.789 | B.186 | C.3 |
| 1.790 | B.187 | C.3 |
| 1.791 | B.188 | C.3 |
| 1.792 | B.189 | C.3 |
| 1.793 | B.190 | C.3 |
| 1.794 | B.191 | C.3 |
| 1.795 | B.192 | C.3 |
| 1.796 | B.193 | C.3 |
| 1.797 | B.194 | C.3 |
| 1.798 | B.195 | C.3 |
| 1.799 | B.196 | C.3 |
| 1.800 | B.197 | C.3 |
| 1.801 | B.198 | C.3 |
| 1.802 | B.199 | C.3 |
| 1.803 | B.200 | C.3 |
| 1.804 | B.201 | C.3 |
| 1.805 | B.1 | C.4 |
| 1.806 | B.2 | C.4 |
| 1.807 | B.3 | C.4 |
| 1.808 | B.4 | C.4 |
| 1.809 | B.5 | C.4 |
| 1.810 | B.6 | C.4 |
| 1.811 | B.7 | C.4 |
| 1.812 | B.8 | C.4 |
| 1.813 | B.9 | C.4 |
| 1.814 | B.10 | C.4 |
| 1.815 | B.11 | C.4 |
| 1.816 | B.12 | C.4 |
| 1.817 | B.13 | C.4 |
| 1.818 | B.14 | C.4 |
| 1.819 | B.15 | C.4 |
| 1.820 | B.16 | C.4 |
| 1.821 | B.17 | C.4 |
| 1.822 | B.18 | C.4 |
| 1.823 | B.19 | C.4 |
| 1.824 | B.20 | C.4 |
| 1.825 | B.21 | C.4 |
| 1.826 | B.22 | C.4 |
| 1.827 | B.23 | C.4 |
| 1.828 | B.24 | C.4 |
| 1.829 | B.25 | C.4 |

TABLE 1-continued (compositions 1.1 to 1.3635):

| comp. no. | herbicide B | safener C |
|---|---|---|
| 1.830 | B.26 | C.4 |
| 1.831 | B.27 | C.4 |
| 1.832 | B.28 | C.4 |
| 1.833 | B.29 | C.4 |
| 1.834 | B.30 | C.4 |
| 1.835 | B.31 | C.4 |
| 1.836 | B.32 | C.4 |
| 1.837 | B.33 | C.4 |
| 1.838 | B.34 | C.4 |
| 1.839 | B.35 | C.4 |
| 1.840 | B.36 | C.4 |
| 1.841 | B.37 | C.4 |
| 1.842 | B.38 | C.4 |
| 1.843 | B.39 | C.4 |
| 1.844 | B.40 | C.4 |
| 1.845 | B.41 | C.4 |
| 1.846 | B.42 | C.4 |
| 1.847 | B.43 | C.4 |
| 1.848 | B.44 | C.4 |
| 1.849 | B.45 | C.4 |
| 1.850 | B.46 | C.4 |
| 1.851 | B.47 | C.4 |
| 1.852 | B.48 | C.4 |
| 1.853 | B.49 | C.4 |
| 1.854 | B.50 | C.4 |
| 1.855 | B.51 | C.4 |
| 1.856 | B.52 | C.4 |
| 1.857 | B.53 | C.4 |
| 1.858 | B.54 | C.4 |
| 1.859 | B.55 | C.4 |
| 1.860 | B.56 | C.4 |
| 1.861 | B.57 | C.4 |
| 1.862 | B.58. | C.4 |
| 1.863 | B.59 | C.4 |
| 1.864 | B.60 | C.4 |
| 1.865 | B.61 | C.4 |
| 1.866 | B.62 | C.4 |
| 1.867 | B.63 | C.4 |
| 1.868 | B.64 | C.4 |
| 1.869 | B.65 | C.4 |
| 1.870 | B.66 | C.4 |
| 1.871 | B.67 | C.4 |
| 1.872 | B.68 | C.4 |
| 1.873 | B.69 | C.4 |
| 1.874 | B.70 | C.4 |
| 1.875 | B.71 | C.4 |
| 1.876 | B.72 | C.4 |
| 1.877 | B.73 | C.4 |
| 1.878 | B.74 | C.4 |
| 1.879 | B.75 | C.4 |
| 1.880 | B.76 | C.4 |
| 1.881 | B.77 | C.4 |
| 1.882 | B.78 | C.4 |
| 1.883 | B.79 | C.4 |
| 1.884 | B.80 | C.4 |
| 1.885 | B.81 | C.4 |
| 1.886 | B.82 | C.4 |
| 1.887 | B.83 | C.4 |
| 1.888 | B.84 | C.4 |
| 1.889 | B.85 | C.4 |
| 1.890 | B.86 | C.4 |
| 1.891 | B.87 | C.4 |
| 1.892 | B.88 | C.4 |
| 1.893 | B.89 | C.4 |
| 1.894 | B.90 | C.4 |
| 1.895 | B.91 | C.4 |
| 1.896 | B.92 | C.4 |
| 1.897 | B.93 | C.4 |
| 1.898 | B.94 | C.4 |
| 1.899 | B.95 | C.4 |
| 1.900 | B.96 | C.4 |
| 1.901 | B.97 | C.4 |
| 1.902 | B.98 | C.4 |
| 1.903 | B.99 | C.4 |
| 1.904 | B.100 | C.4 |
| 1.905 | B.101 | C.4 |
| 1.906 | B.102 | C.4 |
| 1.907 | B.103 | C.4 |
| 1.908 | B.104 | C.4 |
| 1.909 | B.105 | C.4 |
| 1.910 | B.106 | C.4 |
| 1.911 | B.107 | C.4 |
| 1.912 | B.108 | C.4 |
| 1.913 | B.109 | C.4 |
| 1.914 | B.110 | C.4 |
| 1.915 | B.111 | C.4 |
| 1.916 | B.112 | C.4 |
| 1.917 | B.113 | C.4 |
| 1.918 | B.114 | C.4 |
| 1.919 | B.115 | C.4 |
| 1.920 | B.116 | C.4 |
| 1.921 | B.117 | C.4 |
| 1.922 | B.118 | C.4 |
| 1.923 | B.119 | C.4 |
| 1.924 | B.120 | C.4 |
| 1.925 | B.121 | C.4 |
| 1.926 | B.122 | C.4 |
| 1.927 | B.123 | C.4 |
| 1.928 | B.124 | C.4 |
| 1.929 | B.125 | C.4 |
| 1.930 | B.126 | C.4 |
| 1.931 | B.127 | C.4 |
| 1.932 | B.128 | C.4 |
| 1.933 | B.129 | C.4 |
| 1.934 | B.130 | C.4 |
| 1.935 | B.131 | C.4 |
| 1.936 | B.132 | C.4 |
| 1.937 | B.133 | C.4 |
| 1.938 | B.134 | C.4 |
| 1.939 | B.135 | C.4 |
| 1.940 | B.136 | C.4 |
| 1.941 | B.137 | C.4 |
| 1.942 | B.138 | C.4 |
| 1.943 | B.139 | C.4 |
| 1.944 | B.140 | C.4 |
| 1.945 | B.141 | C.4 |
| 1.946 | B.142 | C.4 |
| 1.947 | B.143 | C.4 |
| 1.948 | B.144 | C.4 |
| 1.949 | B.145 | C.4 |
| 1.950 | B.146 | C.4 |
| 1.951 | B.147 | C.4 |
| 1.952 | B.148 | C.4 |
| 1.953 | B.149 | C.4 |
| 1.954 | B.150 | C.4 |
| 1.955 | B.151 | C.4 |
| 1.956 | B.152 | C.4 |
| 1.957 | B.153 | C.4 |
| 1.958 | B.154 | C.4 |
| 1.959 | B.155 | C.4 |
| 1.960 | B.156 | C.4 |
| 1.961 | B.157 | C.4 |
| 1.962 | B.158 | C.4 |
| 1.963 | B.159 | C.4 |
| 1.964 | B.160 | C.4 |
| 1.965 | B.161 | C.4 |
| 1.966 | B.162 | C.4 |
| 1.967 | B.163 | C.4 |
| 1.968 | B.164 | C.4 |
| 1.969 | B.165 | C.4 |
| 1.970 | B.166 | C.4 |
| 1.971 | B.167 | C.4 |
| 1.972 | B.168 | C.4 |
| 1.973 | B.169 | C.4 |
| 1.974 | B.170 | C.4 |
| 1.975 | B.171 | C.4 |
| 1.976 | B.172 | C.4 |
| 1.977 | B.173 | C.4 |
| 1.978 | B.174 | C.4 |
| 1.979 | B.175 | C.4 |

TABLE 1-continued (compositions 1.1 to 1.3635):

| comp. no. | herbicide B | safener C |
|---|---|---|
| 1.980 | B.176 | C.4 |
| 1.981 | B.177 | C.4 |
| 1.982 | B.178 | C.4 |
| 1.983 | B.179 | C.4 |
| 1.984 | B.180 | C.4 |
| 1.985 | B.181 | C.4 |
| 1.986 | B.182 | C.4 |
| 1.987 | B.183 | C.4 |
| 1.988 | B.184 | C.4 |
| 1.989 | B.185 | C.4 |
| 1.990 | B.186 | C.4 |
| 1.991 | B.187 | C.4 |
| 1.992 | B.188 | C.4 |
| 1.993 | B.189 | C.4 |
| 1.994 | B.190 | C.4 |
| 1.995 | B.191 | C.4 |
| 1.996 | B.192 | C.4 |
| 1.997 | B.193 | C.4 |
| 1.998 | B.194 | C.4 |
| 1.999 | B.195 | C.4 |
| 1.1000 | B.196 | C.4 |
| 1.1001 | B.197 | C.4 |
| 1.1002 | B.198 | C.4 |
| 1.1003 | B.199 | C.4 |
| 1.1004 | B.200 | C.4 |
| 1.1005 | B.201 | C.4 |
| 1.1006 | B.1 | C.5 |
| 1.1007 | B.2 | C.5 |
| 1.1008 | B.3 | C.5 |
| 1.1009 | B.4 | C.5 |
| 1.1010 | B.5 | C.5 |
| 1.1011 | B.6 | C.5 |
| 1.1012 | B.7 | C.5 |
| 1.1013 | B.8 | C.5 |
| 1.1014 | B.9 | C.5 |
| 1.1015 | B.10 | C.5 |
| 1.1016 | B.11 | C.5 |
| 1.1017 | B.12 | C.5 |
| 1.1018 | B.13 | C.5 |
| 1.1019 | B.14 | C.5 |
| 1.1020 | B.15 | C.5 |
| 1.1021 | B.16 | C.5 |
| 1.1022 | B.17 | C.5 |
| 1.1023 | B.18 | C.5 |
| 1.1024 | B.19 | C.5 |
| 1.1025 | B.20 | C.5 |
| 1.1026 | B.21 | C.5 |
| 1.1027 | B.22 | C.5 |
| 1.1028 | B.23 | C.5 |
| 1.1029 | B.24 | C.5 |
| 1.1030 | B.25 | C.5 |
| 1.1031 | B.26 | C.5 |
| 1.1032 | B.27 | C.5 |
| 1.1033 | B.28 | C.5 |
| 1.1034 | B.29 | C.5 |
| 1.1035 | B.30 | C.5 |
| 1.1036 | B.31 | C.5 |
| 1.1037 | B.32 | C.5 |
| 1.1038 | B.33 | C.5 |
| 1.1039 | B.34 | C.5 |
| 1.1040 | B.35 | C.5 |
| 1.1041 | B.36 | C.5 |
| 1.1042 | B.37 | C.5 |
| 1.1043 | B.38 | C.5 |
| 1.1044 | B.39 | C.5 |
| 1.1045 | B.40 | C.5 |
| 1.1046 | B.41 | C.5 |
| 1.1047 | B.42 | C.5 |
| 1.1048 | B.43 | C.5 |
| 1.1049 | B.44 | C.5 |
| 1.1050 | B.45 | C.5 |
| 1.1051 | B.46 | C.5 |
| 1.1052 | B.47 | C.5 |
| 1.1053 | B.48 | C.5 |
| 1.1054 | B.49 | C.5 |
| 1.1055 | B.50 | C.5 |
| 1.1056 | B.51 | C.5 |
| 1.1057 | B.52 | C.5 |
| 1.1058 | B.53 | C.5 |
| 1.1059 | B.54 | C.5 |
| 1.1060 | B.55 | C.5 |
| 1.1061 | B.56 | C.5 |
| 1.1062 | B.57 | C.5 |
| 1.1063 | B.58. | C.5 |
| 1.1064 | B.59 | C.5 |
| 1.1065 | B.60 | C.5 |
| 1.1066 | B.61 | C.5 |
| 1.1067 | B.62 | C.5 |
| 1.1068 | B.63 | C.5 |
| 1.1069 | B.64 | C.5 |
| 1.1070 | B.65 | C.5 |
| 1.1071 | B.66 | C.5 |
| 1.1072 | B.67 | C.5 |
| 1.1073 | B.68 | C.5 |
| 1.1074 | B.69 | C.5 |
| 1.1075 | B.70 | C.5 |
| 1.1076 | B.71 | C.5 |
| 1.1077 | B.72 | C.5 |
| 1.1078 | B.73 | C.5 |
| 1.1079 | B.74 | C.5 |
| 1.1080 | B.75 | C.5 |
| 1.1081 | B.76 | C.5 |
| 1.1082 | B.77 | C.5 |
| 1.1083 | B.78 | C.5 |
| 1.1084 | B.79 | C.5 |
| 1.1085 | B.80 | C.5 |
| 1.1086 | B.81 | C.5 |
| 1.1087 | B.82 | C.5 |
| 1.1088 | B.83 | C.5 |
| 1.1089 | B.84 | C.5 |
| 1.1090 | B.85 | C.5 |
| 1.1091 | B.86 | C.5 |
| 1.1092 | B.87 | C.5 |
| 1.1093 | B.88 | C.5 |
| 1.1094 | B.89 | C.5 |
| 1.1095 | B.90 | C.5 |
| 1.1096 | B.91 | C.5 |
| 1.1097 | B.92 | C.5 |
| 1.1098 | B.93 | C.5 |
| 1.1099 | B.94 | C.5 |
| 1.1100 | B.95 | C.5 |
| 1.1101 | B.96 | C.5 |
| 1.1102 | B.97 | C.5 |
| 1.1103 | B.98 | C.5 |
| 1.1104 | B.99 | C.5 |
| 1.1105 | B.100 | C.5 |
| 1.1106 | B.101 | C.5 |
| 1.1107 | B.102 | C.5 |
| 1.1108 | B.103 | C.5 |
| 1.1109 | B.104 | C.5 |
| 1.1110 | B.105 | C.5 |
| 1.1111 | B.106 | C.5 |
| 1.1112 | B.107 | C.5 |
| 1.1113 | B.108 | C.5 |
| 1.1114 | B.109 | C.5 |
| 1.1115 | B.110 | C.5 |
| 1.1116 | B.111 | C.5 |
| 1.1117 | B.112 | C.5 |
| 1.1118 | B.113 | C.5 |
| 1.1119 | B.114 | C.5 |
| 1.1120 | B.115 | C.5 |
| 1.1121 | B.116 | C.5 |
| 1.1122 | B.117 | C.5 |
| 1.1123 | B.118 | C.5 |
| 1.1124 | B.119 | C.5 |
| 1.1125 | B.120 | C.5 |
| 1.1126 | B.121 | C.5 |
| 1.1127 | B.122 | C.5 |
| 1.1128 | B.123 | C.5 |
| 1.1129 | B.124 | C.5 |

TABLE 1-continued (compositions 1.1 to 1.3635):

| comp. no. | herbicide B | safener C |
|---|---|---|
| 1.1130 | B.125 | C.5 |
| 1.1131 | B.126 | C.5 |
| 1.1132 | B.127 | C.5 |
| 1.1133 | B.128 | C.5 |
| 1.1134 | B.129 | C.5 |
| 1.1135 | B.130 | C.5 |
| 1.1136 | B.131 | C.5 |
| 1.1137 | B.132 | C.5 |
| 1.1138 | B.133 | C.5 |
| 1.1139 | B.134 | C.5 |
| 1.1140 | B.135 | C.5 |
| 1.1141 | B.136 | C.5 |
| 1.1142 | B.137 | C.5 |
| 1.1143 | B.138 | C.5 |
| 1.1144 | B.139 | C.5 |
| 1.1145 | B.140 | C.5 |
| 1.1146 | B.141 | C.5 |
| 1.1147 | B.142 | C.5 |
| 1.1148 | B.143 | C.5 |
| 1.1149 | B.144 | C.5 |
| 1.1150 | B.145 | C.5 |
| 1.1151 | B.146 | C.5 |
| 1.1152 | B.147 | C.5 |
| 1.1153 | B.148 | C.5 |
| 1.1154 | B.149 | C.5 |
| 1.1155 | B.150 | C.5 |
| 1.1156 | B.151 | C.5 |
| 1.1157 | B.152 | C.5 |
| 1.1158 | B.153 | C.5 |
| 1.1159 | B.154 | C.5 |
| 1.1160 | B.155 | C.5 |
| 1.1161 | B.156 | C.5 |
| 1.1162 | B.157 | C.5 |
| 1.1163 | B.158 | C.5 |
| 1.1164 | B.159 | C.5 |
| 1.1165 | B.160 | C.5 |
| 1.1166 | B.161 | C.5 |
| 1.1167 | B.162 | C.5 |
| 1.1168 | B.163 | C.5 |
| 1.1169 | B.164 | C.5 |
| 1.1170 | B.165 | C.5 |
| 1.1171 | B.166 | C.5 |
| 1.1172 | B.167 | C.5 |
| 1.1173 | B.168 | C.5 |
| 1.1174 | B.169 | C.5 |
| 1.1175 | B.170 | C.5 |
| 1.1176 | B.171 | C.5 |
| 1.1177 | B.172 | C.5 |
| 1.1178 | B.173 | C.5 |
| 1.1179 | B.174 | C.5 |
| 1.1180 | B.175 | C.5 |
| 1.1181 | B.176 | C.5 |
| 1.1182 | B.177 | C.5 |
| 1.1183 | B.178 | C.5 |
| 1.1184 | B.179 | C.5 |
| 1.1185 | B.180 | C.5 |
| 1.1186 | B.181 | C.5 |
| 1.1187 | B.182 | C.5 |
| 1.1188 | B.183 | C.5 |
| 1.1189 | B.184 | C.5 |
| 1.1190 | B.185 | C.5 |
| 1.1191 | B.186 | C.5 |
| 1.1192 | B.187 | C.5 |
| 1.1193 | B.188 | C.5 |
| 1.1194 | B.189 | C.5 |
| 1.1195 | B.190 | C.5 |
| 1.1196 | B.191 | C.5 |
| 1.1197 | B.192 | C.5 |
| 1.1198 | B.193 | C.5 |
| 1.1199 | B.194 | C.5 |
| 1.1200 | B.195 | C.5 |
| 1.1201 | B.196 | C.5 |
| 1.1202 | B.197 | C.5 |
| 1.1203 | B.198 | C.5 |
| 1.1204 | B.199 | C.5 |
| 1.1205 | B.200 | C.5 |
| 1.1206 | B.201 | C.5 |
| 1.1207 | B.1 | C.6 |
| 1.1208 | B.2 | C.6 |
| 1.1209 | B.3 | C.6 |
| 1.1210 | B.4 | C.6 |
| 1.1211 | B.5 | C.6 |
| 1.1212 | B.6 | C.6 |
| 1.1213 | B.7 | C.6 |
| 1.1214 | B.8 | C.6 |
| 1.1215 | B.9 | C.6 |
| 1.1216 | B.10 | C.6 |
| 1.1217 | B.11 | C.6 |
| 1.1218 | B.12 | C.6 |
| 1.1219 | B.13 | C.6 |
| 1.1220 | B.14 | C.6 |
| 1.1221 | B.15 | C.6 |
| 1.1222 | B.16 | C.6 |
| 1.1223 | B.17 | C.6 |
| 1.1224 | B.18 | C.6 |
| 1.1225 | B.19 | C.6 |
| 1.1226 | B.20 | C.6 |
| 1.1227 | B.21 | C.6 |
| 1.1228 | B.22 | C.6 |
| 1.1229 | B.23 | C.6 |
| 1.1230 | B.24 | C.6 |
| 1.1231 | B.25 | C.6 |
| 1.1232 | B.26 | C.6 |
| 1.1233 | B.27 | C.6 |
| 1.1234 | B.28 | C.6 |
| 1.1235 | B.29 | C.6 |
| 1.1236 | B.30 | C.6 |
| 1.1237 | B.31 | C.6 |
| 1.1238 | B.32 | C.6 |
| 1.1239 | B.33 | C.6 |
| 1.1240 | B.34 | C.6 |
| 1.1241 | B.35 | C.6 |
| 1.1242 | B.36 | C.6 |
| 1.1243 | B.37 | C.6 |
| 1.1244 | B.38 | C.6 |
| 1.1245 | B.39 | C.6 |
| 1.1246 | B.40 | C.6 |
| 1.1247 | B.41 | C.6 |
| 1.1248 | B.42 | C.6 |
| 1.1249 | B.43 | C.6 |
| 1.1250 | B.44 | C.6 |
| 1.1251 | B.45 | C.6 |
| 1.1252 | B.46 | C.6 |
| 1.1253 | B.47 | C.6 |
| 1.1254 | B.48 | C.6 |
| 1.1255 | B.49 | C.6 |
| 1.1256 | B.50 | C.6 |
| 1.1257 | B.51 | C.6 |
| 1.1258 | B.52 | C.6 |
| 1.1259 | B.53 | C.6 |
| 1.1260 | B.54 | C.6 |
| 1.1261 | B.55 | C.6 |
| 1.1262 | B.56 | C.6 |
| 1.1263 | B.57 | C.6 |
| 1.1264 | B.58. | C.6 |
| 1.1265 | B.59 | C.6 |
| 1.1266 | B.60 | C.6 |
| 1.1267 | B.61 | C.6 |
| 1.1268 | B.62 | C.6 |
| 1.1269 | B.63 | C.6 |
| 1.1270 | B.64 | C.6 |
| 1.1271 | B.65 | C.6 |
| 1.1272 | B.66 | C.6 |
| 1.1273 | B.67 | C.6 |
| 1.1274 | B.68 | C.6 |
| 1.1275 | B.69 | C.6 |
| 1.1276 | B.70 | C.6 |
| 1.1277 | B.71 | C.6 |
| 1.1278 | B.72 | C.6 |
| 1.1279 | B.73 | C.6 |

TABLE 1-continued (compositions 1.1 to 1.3635):

| comp. no. | herbicide B | safener C |
|---|---|---|
| 1.1280 | B.74 | C.6 |
| 1.1281 | B.75 | C.6 |
| 1.1282 | B.76 | C.6 |
| 1.1283 | B.77 | C.6 |
| 1.1284 | B.78 | C.6 |
| 1.1285 | B.79 | C.6 |
| 1.1286 | B.80 | C.6 |
| 1.1287 | B.81 | C.6 |
| 1.1288 | B.82 | C.6 |
| 1.1289 | B.83 | C.6 |
| 1.1290 | B.84 | C.6 |
| 1.1291 | B.85 | C.6 |
| 1.1292 | B.86 | C.6 |
| 1.1293 | B.87 | C.6 |
| 1.1294 | B.88 | C.6 |
| 1.1295 | B.89 | C.6 |
| 1.1296 | B.90 | C.6 |
| 1.1297 | B.91 | C.6 |
| 1.1298 | B.92 | C.6 |
| 1.1299 | B.93 | C.6 |
| 1.1300 | B.94 | C.6 |
| 1.1301 | B.95 | C.6 |
| 1.1302 | B.96 | C.6 |
| 1.1303 | B.97 | C.6 |
| 1.1304 | B.98 | C.6 |
| 1.1305 | B.99 | C.6 |
| 1.1306 | B.100 | C.6 |
| 1.1307 | B.101 | C.6 |
| 1.1308 | B.102 | C.6 |
| 1.1309 | B.103 | C.6 |
| 1.1310 | B.104 | C.6 |
| 1.1311 | B.105 | C.6 |
| 1.1312 | B.106 | C.6 |
| 1.1313 | B.107 | C.6 |
| 1.1314 | B.108 | C.6 |
| 1.1315 | B.109 | C.6 |
| 1.1316 | B.110 | C.6 |
| 1.1317 | B.111 | C.6 |
| 1.1318 | B.112 | C.6 |
| 1.1319 | B.113 | C.6 |
| 1.1320 | B.114 | C.6 |
| 1.1321 | B.115 | C.6 |
| 1.1322 | B.116 | C.6 |
| 1.1323 | B.117 | C.6 |
| 1.1324 | B.118 | C.6 |
| 1.1325 | B.119 | C.6 |
| 1.1326 | B.120 | C.6 |
| 1.1327 | B.121 | C.6 |
| 1.1328 | B.122 | C.6 |
| 1.1329 | B.123 | C.6 |
| 1.1330 | B.124 | C.6 |
| 1.1331 | B.125 | C.6 |
| 1.1332 | B.126 | C.6 |
| 1.1333 | B.127 | C.6 |
| 1.1334 | B.128 | C.6 |
| 1.1335 | B.129 | C.6 |
| 1.1336 | B.130 | C.6 |
| 1.1337 | B.131 | C.6 |
| 1.1338 | B.132 | C.6 |
| 1.1339 | B.133 | C.6 |
| 1.1340 | B.134 | C.6 |
| 1.1341 | B.135 | C.6 |
| 1.1342 | B.136 | C.6 |
| 1.1343 | B.137 | C.6 |
| 1.1344 | B.138 | C.6 |
| 1.1345 | B.139 | C.6 |
| 1.1346 | B.140 | C.6 |
| 1.1347 | B.141 | C.6 |
| 1.1348 | B.142 | C.6 |
| 1.1349 | B.143 | C.6 |
| 1.1350 | B.144 | C.6 |
| 1.1351 | B.145 | C.6 |
| 1.1352 | B.146 | C.6 |
| 1.1353 | B.147 | C.6 |
| 1.1354 | B.148 | C.6 |
| 1.1355 | B.149 | C.6 |
| 1.1356 | B.150 | C.6 |
| 1.1357 | B.151 | C.6 |
| 1.1358 | B.152 | C.6 |
| 1.1359 | B.153 | C.6 |
| 1.1360 | B.154 | C.6 |
| 1.1361 | B.155 | C.6 |
| 1.1362 | B.156 | C.6 |
| 1.1363 | B.157 | C.6 |
| 1.1364 | B.158 | C.6 |
| 1.1365 | B.159 | C.6 |
| 1.1366 | B.160 | C.6 |
| 1.1367 | B.161 | C.6 |
| 1.1368 | B.162 | C.6 |
| 1.1369 | B.163 | C.6 |
| 1.1370 | B.164 | C.6 |
| 1.1371 | B.165 | C.6 |
| 1.1372 | B.166 | C.6 |
| 1.1373 | B.167 | C.6 |
| 1.1374 | B.168 | C.6 |
| 1.1375 | B.169 | C.6 |
| 1.1376 | B.170 | C.6 |
| 1.1377 | B.171 | C.6 |
| 1.1378 | B.172 | C.6 |
| 1.1379 | B.173 | C.6 |
| 1.1380 | B.174 | C.6 |
| 1.1381 | B.175 | C.6 |
| 1.1382 | B.176 | C.6 |
| 1.1383 | B.177 | C.6 |
| 1.1384 | B.178 | C.6 |
| 1.1385 | B.179 | C.6 |
| 1.1386 | B.180 | C.6 |
| 1.1387 | B.181 | C.6 |
| 1.1388 | B.182 | C.6 |
| 1.1389 | B.183 | C.6 |
| 1.1390 | B.184 | C.6 |
| 1.1391 | B.185 | C.6 |
| 1.1392 | B.186 | C.6 |
| 1.1393 | B.187 | C.6 |
| 1.1394 | B.188 | C.6 |
| 1.1395 | B.189 | C.6 |
| 1.1396 | B.190 | C.6 |
| 1.1397 | B.191 | C.6 |
| 1.1398 | B.192 | C.6 |
| 1.1399 | B.193 | C.6 |
| 1.1400 | B.194 | C.6 |
| 1.1401 | B.195 | C.6 |
| 1.1402 | B.196 | C.6 |
| 1.1403 | B.197 | C.6 |
| 1.1404 | B.198 | C.6 |
| 1.1405 | B.199 | C.6 |
| 1.1406 | B.200 | C.6 |
| 1.1407 | B.201 | C.6 |
| 1.1408 | B.1 | C.7 |
| 1.1409 | B.2 | C.7 |
| 1.1410 | B.3 | C.7 |
| 1.1411 | B.4 | C.7 |
| 1.1412 | B.5 | C.7 |
| 1.1413 | B.6 | C.7 |
| 1.1414 | B.7 | C.7 |
| 1.1415 | B.8 | C.7 |
| 1.1416 | B.9 | C.7 |
| 1.1417 | B.10 | C.7 |
| 1.1418 | B.11 | C.7 |
| 1.1419 | B.12 | C.7 |
| 1.1420 | B.13 | C.7 |
| 1.1421 | B.14 | C.7 |
| 1.1422 | B.15 | C.7 |
| 1.1423 | B.16 | C.7 |
| 1.1424 | B.17 | C.7 |
| 1.1425 | B.18 | C.7 |
| 1.1426 | B.19 | C.7 |
| 1.1427 | B.20 | C.7 |
| 1.1428 | B.21 | C.7 |
| 1.1429 | B.22 | C.7 |

TABLE 1-continued (compositions 1.1 to 1.3635):

| comp. no. | herbicide B | safener C |
|---|---|---|
| 1.1430 | B.23 | C.7 |
| 1.1431 | B.24 | C.7 |
| 1.1432 | B.25 | C.7 |
| 1.1433 | B.26 | C.7 |
| 1.1434 | B.27 | C.7 |
| 1.1435 | B.28 | C.7 |
| 1.1436 | B.29 | C.7 |
| 1.1437 | B.30 | C.7 |
| 1.1438 | B.31 | C.7 |
| 1.1439 | B.32 | C.7 |
| 1.1440 | B.33 | C.7 |
| 1.1441 | B.34 | C.7 |
| 1.1442 | B.35 | C.7 |
| 1.1443 | B.36 | C.7 |
| 1.1444 | B.37 | C.7 |
| 1.1445 | B.38 | C.7 |
| 1.1446 | B.39 | C.7 |
| 1.1447 | B.40 | C.7 |
| 1.1448 | B.41 | C.7 |
| 1.1449 | B.42 | C.7 |
| 1.1450 | B.43 | C.7 |
| 1.1451 | B.44 | C.7 |
| 1.1452 | B.45 | C.7 |
| 1.1453 | B.46 | C.7 |
| 1.1454 | B.47 | C.7 |
| 1.1455 | B.48 | C.7 |
| 1.1456 | B.49 | C.7 |
| 1.1457 | B.50 | C.7 |
| 1.1458 | B.51 | C.7 |
| 1.1459 | B.52 | C.7 |
| 1.1460 | B.53 | C.7 |
| 1.1461 | B.54 | C.7 |
| 1.1462 | B.55 | C.7 |
| 1.1463 | B.56 | C.7 |
| 1.1464 | B.57 | C.7 |
| 1.1465 | B.58. | C.7 |
| 1.1466 | B.59 | C.7 |
| 1.1467 | B.60 | C.7 |
| 1.1468 | B.61 | C.7 |
| 1.1469 | B.62 | C.7 |
| 1.1470 | B.63 | C.7 |
| 1.1471 | B.64 | C.7 |
| 1.1472 | B.65 | C.7 |
| 1.1473 | B.66 | C.7 |
| 1.1474 | B.67 | C.7 |
| 1.1475 | B.68 | C.7 |
| 1.1476 | B.69 | C.7 |
| 1.1477 | B.70 | C.7 |
| 1.1478 | B.71 | C.7 |
| 1.1479 | B.72 | C.7 |
| 1.1480 | B.73 | C.7 |
| 1.1481 | B.74 | C.7 |
| 1.1482 | B.75 | C.7 |
| 1.1483 | B.76 | C.7 |
| 1.1484 | B.77 | C.7 |
| 1.1485 | B.78 | C.7 |
| 1.1486 | B.79 | C.7 |
| 1.1487 | B.80 | C.7 |
| 1.1488 | B.81 | C.7 |
| 1.1489 | B.82 | C.7 |
| 1.1490 | B.83 | C.7 |
| 1.1491 | B.84 | C.7 |
| 1.1492 | B.85 | C.7 |
| 1.1493 | B.86 | C.7 |
| 1.1494 | B.87 | C.7 |
| 1.1495 | B.88 | C.7 |
| 1.1496 | B.89 | C.7 |
| 1.1497 | B.90 | C.7 |
| 1.1498 | B.91 | C.7 |
| 1.1499 | B.92 | C.7 |
| 1.1500 | B.93 | C.7 |
| 1.1501 | B.94 | C.7 |
| 1.1502 | B.95 | C.7 |
| 1.1503 | B.96 | C.7 |
| 1.1504 | B.97 | C.7 |
| 1.1505 | B.98 | C.7 |
| 1.1506 | B.99 | C.7 |
| 1.1507 | B.100 | C.7 |
| 1.1508 | B.101 | C.7 |
| 1.1509 | B.102 | C.7 |
| 1.1510 | B.103 | C.7 |
| 1.1511 | B.104 | C.7 |
| 1.1512 | B.105 | C.7 |
| 1.1513 | B.106 | C.7 |
| 1.1514 | B.107 | C.7 |
| 1.1515 | B.108 | C.7 |
| 1.1516 | B.109 | C.7 |
| 1.1517 | B.110 | C.7 |
| 1.1518 | B.111 | C.7 |
| 1.1519 | B.112 | C.7 |
| 1.1520 | B.113 | C.7 |
| 1.1521 | B.114 | C.7 |
| 1.1522 | B.115 | C.7 |
| 1.1523 | B.116 | C.7 |
| 1.1524 | B.117 | C.7 |
| 1.1525 | B.118 | C.7 |
| 1.1526 | B.119 | C.7 |
| 1.1527 | B.120 | C.7 |
| 1.1528 | B.121 | C.7 |
| 1.1529 | B.122 | C.7 |
| 1.1530 | B.123 | C.7 |
| 1.1531 | B.124 | C.7 |
| 1.1532 | B.125 | C.7 |
| 1.1533 | B.126 | C.7 |
| 1.1534 | B.127 | C.7 |
| 1.1535 | B.128 | C.7 |
| 1.1536 | B.129 | C.7 |
| 1.1537 | B.130 | C.7 |
| 1.1538 | B.131 | C.7 |
| 1.1539 | B.132 | C.7 |
| 1.1540 | B.133 | C.7 |
| 1.1541 | B.134 | C.7 |
| 1.1542 | B.135 | C.7 |
| 1.1543 | B.136 | C.7 |
| 1.1544 | B.137 | C.7 |
| 1.1545 | B.138 | C.7 |
| 1.1546 | B.139 | C.7 |
| 1.1547 | B.140 | C.7 |
| 1.1548 | B.141 | C.7 |
| 1.1549 | B.142 | C.7 |
| 1.1550 | B.143 | C.7 |
| 1.1551 | B.144 | C.7 |
| 1.1552 | B.145 | C.7 |
| 1.1553 | B.146 | C.7 |
| 1.1554 | B.147 | C.7 |
| 1.1555 | B.148 | C.7 |
| 1.1556 | B.149 | C.7 |
| 1.1557 | B.150 | C.7 |
| 1.1558 | B.151 | C.7 |
| 1.1559 | B.152 | C.7 |
| 1.1560 | B.153 | C.7 |
| 1.1561 | B.154 | C.7 |
| 1.1562 | B.155 | C.7 |
| 1.1563 | B.156 | C.7 |
| 1.1564 | B.157 | C.7 |
| 1.1565 | B.158 | C.7 |
| 1.1566 | B.159 | C.7 |
| 1.1567 | B.160 | C.7 |
| 1.1568 | B.161 | C.7 |
| 1.1569 | B.162 | C.7 |
| 1.1570 | B.163 | C.7 |
| 1.1571 | B.164 | C.7 |
| 1.1572 | B.165 | C.7 |
| 1.1573 | B.166 | C.7 |
| 1.1574 | B.167 | C.7 |
| 1.1575 | B.168 | C.7 |
| 1.1576 | B.169 | C.7 |
| 1.1577 | B.170 | C.7 |
| 1.1578 | B.171 | C.7 |
| 1.1579 | B.172 | C.7 |

TABLE 1-continued (compositions 1.1 to 1.3635):

| comp. no. | herbicide B | safener C |
|---|---|---|
| 1.1580 | B.173 | C.7 |
| 1.1581 | B.174 | C.7 |
| 1.1582 | B.175 | C.7 |
| 1.1583 | B.176 | C.7 |
| 1.1584 | B.177 | C.7 |
| 1.1585 | B.178 | C.7 |
| 1.1586 | B.179 | C.7 |
| 1.1587 | B.180 | C.7 |
| 1.1588 | B.181 | C.7 |
| 1.1589 | B.182 | C.7 |
| 1.1590 | B.183 | C.7 |
| 1.1591 | B.184 | C.7 |
| 1.1592 | B.185 | C.7 |
| 1.1593 | B.186 | C.7 |
| 1.1594 | B.187 | C.7 |
| 1.1595 | B.188 | C.7 |
| 1.1596 | B.189 | C.7 |
| 1.1597 | B.190 | C.7 |
| 1.1598 | B.191 | C.7 |
| 1.1599 | B.192 | C.7 |
| 1.1600 | B.193 | C.7 |
| 1.1601 | B.194 | C.7 |
| 1.1602 | B.195 | C.7 |
| 1.1603 | B.196 | C.7 |
| 1.1604 | B.197 | C.7 |
| 1.1605 | B.198 | C.7 |
| 1.1606 | B.199 | C.7 |
| 1.1607 | B.200 | C.7 |
| 1.1608 | B.201 | C.7 |
| 1.1609 | B.1 | C.8 |
| 1.1610 | B.2 | C.8 |
| 1.1611 | B.3 | C.8 |
| 1.1612 | B.4 | C.8 |
| 1.1613 | B.5 | C.8 |
| 1.1614 | B.6 | C.8 |
| 1.1615 | B.7 | C.8 |
| 1.1616 | B.8 | C.8 |
| 1.1617 | B.9 | C.8 |
| 1.1618 | B.10 | C.8 |
| 1.1619 | B.11 | C.8 |
| 1.1620 | B.12 | C.8 |
| 1.1621 | B.13 | C.8 |
| 1.1622 | B.14 | C.8 |
| 1.1623 | B.15 | C.8 |
| 1.1624 | B.16 | C.8 |
| 1.1625 | B.17 | C.8 |
| 1.1626 | B.18 | C.8 |
| 1.1627 | B.19 | C.8 |
| 1.1628 | B.20 | C.8 |
| 1.1629 | B.21 | C.8 |
| 1.1630 | B.22 | C.8 |
| 1.1631 | B.23 | C.8 |
| 1.1632 | B.24 | C.8 |
| 1.1633 | B.25 | C.8 |
| 1.1634 | B.26 | C.8 |
| 1.1635 | B.27 | C.8 |
| 1.1636 | B.28 | C.8 |
| 1.1637 | B.29 | C.8 |
| 1.1638 | B.30 | C.8 |
| 1.1639 | B.31 | C.8 |
| 1.1640 | B.32 | C.8 |
| 1.1641 | B.33 | C.8 |
| 1.1642 | B.34 | C.8 |
| 1.1643 | B.35 | C.8 |
| 1.1644 | B.36 | C.8 |
| 1.1645 | B.37 | C.8 |
| 1.1646 | B.38 | C.8 |
| 1.1647 | B.39 | C.8 |
| 1.1648 | B.40 | C.8 |
| 1.1649 | B.41 | C.8 |
| 1.1650 | B.42 | C.8 |
| 1.1651 | B.43 | C.8 |
| 1.1652 | B.44 | C.8 |
| 1.1653 | B.45 | C.8 |
| 1.1654 | B.46 | C.8 |
| 1.1655 | B.47 | C.8 |
| 1.1656 | B.48 | C.8 |
| 1.1657 | B.49 | C.8 |
| 1.1658 | B.50 | C.8 |
| 1.1659 | B.51 | C.8 |
| 1.1660 | B.52 | C.8 |
| 1.1661 | B.53 | C.8 |
| 1.1662 | B.54 | C.8 |
| 1.1663 | B.55 | C.8 |
| 1.1664 | B.56 | C.8 |
| 1.1665 | B.57 | C.8 |
| 1.1666 | B.58. | C.8 |
| 1.1667 | B.59 | C.8 |
| 1.1668 | B.60 | C.8 |
| 1.1669 | B.61 | C.8 |
| 1.1670 | B.62 | C.8 |
| 1.1671 | B.63 | C.8 |
| 1.1672 | B.64 | C.8 |
| 1.1673 | B.65 | C.8 |
| 1.1674 | B.66 | C.8 |
| 1.1675 | B.67 | C.8 |
| 1.1676 | B.68 | C.8 |
| 1.1677 | B.69 | C.8 |
| 1.1678 | B.70 | C.8 |
| 1.1679 | B.71 | C.8 |
| 1.1680 | B.72 | C.8 |
| 1.1681 | B.73 | C.8 |
| 1.1682 | B.74 | C.8 |
| 1.1683 | B.75 | C.8 |
| 1.1684 | B.76 | C.8 |
| 1.1685 | B.77 | C.8 |
| 1.1686 | B.78 | C.8 |
| 1.1687 | B.79 | C.8 |
| 1.1688 | B.80 | C.8 |
| 1.1689 | B.81 | C.8 |
| 1.1690 | B.82 | C.8 |
| 1.1691 | B.83 | C.8 |
| 1.1692 | B.84 | C.8 |
| 1.1693 | B.85 | C.8 |
| 1.1694 | B.86 | C.8 |
| 1.1695 | B.87 | C.8 |
| 1.1696 | B.88 | C.8 |
| 1.1697 | B.89 | C.8 |
| 1.1698 | B.90 | C.8 |
| 1.1699 | B.91 | C.8 |
| 1.1700 | B.92 | C.8 |
| 1.1701 | B.93 | C.8 |
| 1.1702 | B.94 | C.8 |
| 1.1703 | B.95 | C.8 |
| 1.1704 | B.96 | C.8 |
| 1.1705 | B.97 | C.8 |
| 1.1706 | B.98 | C.8 |
| 1.1707 | B.99 | C.8 |
| 1.1708 | B.100 | C.8 |
| 1.1709 | B.101 | C.8 |
| 1.1710 | B.102 | C.8 |
| 1.1711 | B.103 | C.8 |
| 1.1712 | B.104 | C.8 |
| 1.1713 | B.105 | C.8 |
| 1.1714 | B.106 | C.8 |
| 1.1715 | B.107 | C.8 |
| 1.1716 | B.108 | C.8 |
| 1.1717 | B.109 | C.8 |
| 1.1718 | B.110 | C.8 |
| 1.1719 | B.111 | C.8 |
| 1.1720 | B.112 | C.8 |
| 1.1721 | B.113 | C.8 |
| 1.1722 | B.114 | C.8 |
| 1.1723 | B.115 | C.8 |
| 1.1724 | B.116 | C.8 |
| 1.1725 | B.117 | C.8 |
| 1.1726 | B.118 | C.8 |
| 1.1727 | B.119 | C.8 |
| 1.1728 | B.120 | C.8 |
| 1.1729 | B.121 | C.8 |

TABLE 1-continued (compositions 1.1 to 1.3635):

| comp. no. | herbicide B | safener C |
|---|---|---|
| 1.1730 | B.122 | C.8 |
| 1.1731 | B.123 | C.8 |
| 1.1732 | B.124 | C.8 |
| 1.1733 | B.125 | C.8 |
| 1.1734 | B.126 | C.8 |
| 1.1735 | B.127 | C.8 |
| 1.1736 | B.128 | C.8 |
| 1.1737 | B.129 | C.8 |
| 1.1738 | B.130 | C.8 |
| 1.1739 | B.131 | C.8 |
| 1.1740 | B.132 | C.8 |
| 1.1741 | B.133 | C.8 |
| 1.1742 | B.134 | C.8 |
| 1.1743 | B.135 | C.8 |
| 1.1744 | B.136 | C.8 |
| 1.1745 | B.137 | C.8 |
| 1.1746 | B.138 | C.8 |
| 1.1747 | B.139 | C.8 |
| 1.1748 | B.140 | C.8 |
| 1.1749 | B.141 | C.8 |
| 1.1750 | B.142 | C.8 |
| 1.1751 | B.143 | C.8 |
| 1.1752 | B.144 | C.8 |
| 1.1753 | B.145 | C.8 |
| 1.1754 | B.146 | C.8 |
| 1.1755 | B.147 | C.8 |
| 1.1756 | B.148 | C.8 |
| 1.1757 | B.149 | C.8 |
| 1.1758 | B.150 | C.8 |
| 1.1759 | B.151 | C.8 |
| 1.1760 | B.152 | C.8 |
| 1.1761 | B.153 | C.8 |
| 1.1762 | B.154 | C.8 |
| 1.1763 | B.155 | C.8 |
| 1.1764 | B.156 | C.8 |
| 1.1765 | B.157 | C.8 |
| 1.1766 | B.158 | C.8 |
| 1.1767 | B.159 | C.8 |
| 1.1768 | B.160 | C.8 |
| 1.1769 | B.161 | C.8 |
| 1.1770 | B.162 | C.8 |
| 1.1771 | B.163 | C.8 |
| 1.1772 | B.164 | C.8 |
| 1.1773 | B.165 | C.8 |
| 1.1774 | B.166 | C.8 |
| 1.1775 | B.167 | C.8 |
| 1.1776 | B.168 | C.8 |
| 1.1777 | B.169 | C.8 |
| 1.1778 | B.170 | C.8 |
| 1.1779 | B.171 | C.8 |
| 1.1780 | B.172 | C.8 |
| 1.1781 | B.173 | C.8 |
| 1.1782 | B.174 | C.8 |
| 1.1783 | B.175 | C.8 |
| 1.1784 | B.176 | C.8 |
| 1.1785 | B.177 | C.8 |
| 1.1786 | B.178 | C.8 |
| 1.1787 | B.179 | C.8 |
| 1.1788 | B.180 | C.8 |
| 1.1789 | B.181 | C.8 |
| 1.1790 | B.182 | C.8 |
| 1.1791 | B.183 | C.8 |
| 1.1792 | B.184 | C.8 |
| 1.1793 | B.185 | C.8 |
| 1.1794 | B.186 | C.8 |
| 1.1795 | B.187 | C.8 |
| 1.1796 | B.188 | C.8 |
| 1.1797 | B.189 | C.8 |
| 1.1798 | B.190 | C.8 |
| 1.1799 | B.191 | C.8 |
| 1.1800 | B.192 | C.8 |
| 1.1801 | B.193 | C.8 |
| 1.1802 | B.194 | C.8 |
| 1.1803 | B.195 | C.8 |
| 1.1804 | B.196 | C.8 |
| 1.1805 | B.197 | C.8 |
| 1.1806 | B.198 | C.8 |
| 1.1807 | B.199 | C.8 |
| 1.1808 | B.200 | C.8 |
| 1.1809 | B.201 | C.8 |
| 1.1810 | B.1 | C.9 |
| 1.1811 | B.2 | C.9 |
| 1.1812 | B.3 | C.9 |
| 1.1813 | B.4 | C.9 |
| 1.1814 | B.5 | C.9 |
| 1.1815 | B.6 | C.9 |
| 1.1816 | B.7 | C.9 |
| 1.1817 | B.8 | C.9 |
| 1.1818 | B.9 | C.9 |
| 1.1819 | B.10 | C.9 |
| 1.1820 | B.11 | C.9 |
| 1.1821 | B.12 | C.9 |
| 1.1822 | B.13 | C.9 |
| 1.1823 | B.14 | C.9 |
| 1.1824 | B.15 | C.9 |
| 1.1825 | B.16 | C.9 |
| 1.1826 | B.17 | C.9 |
| 1.1827 | B.18 | C.9 |
| 1.1828 | B.19 | C.9 |
| 1.1829 | B.20 | C.9 |
| 1.1830 | B.21 | C.9 |
| 1.1831 | B.22 | C.9 |
| 1.1832 | B.23 | C.9 |
| 1.1833 | B.24 | C.9 |
| 1.1834 | B.25 | C.9 |
| 1.1835 | B.26 | C.9 |
| 1.1836 | B.27 | C.9 |
| 1.1837 | B.28 | C.9 |
| 1.1838 | B.29 | C.9 |
| 1.1839 | B.30 | C.9 |
| 1.1840 | B.31 | C.9 |
| 1.1841 | B.32 | C.9 |
| 1.1842 | B.33 | C.9 |
| 1.1843 | B.34 | C.9 |
| 1.1844 | B.35 | C.9 |
| 1.1845 | B.36 | C.9 |
| 1.1846 | B.37 | C.9 |
| 1.1847 | B.38 | C.9 |
| 1.1848 | B.39 | C.9 |
| 1.1849 | B.40 | C.9 |
| 1.1850 | B.41 | C.9 |
| 1.1851 | B.42 | C.9 |
| 1.1852 | B.43 | C.9 |
| 1.1853 | B.44 | C.9 |
| 1.1854 | B.45 | C.9 |
| 1.1855 | B.46 | C.9 |
| 1.1856 | B.47 | C.9 |
| 1.1857 | B.48 | C.9 |
| 1.1858 | B.49 | C.9 |
| 1.1859 | B.50 | C.9 |
| 1.1860 | B.51 | C.9 |
| 1.1861 | B.52 | C.9 |
| 1.1862 | B.53 | C.9 |
| 1.1863 | B.54 | C.9 |
| 1.1864 | B.55 | C.9 |
| 1.1865 | B.56 | C.9 |
| 1.1866 | B.57 | C.9 |
| 1.1867 | B.58. | C.9 |
| 1.1868 | B.59 | C.9 |
| 1.1869 | B.60 | C.9 |
| 1.1870 | B.61 | C.9 |
| 1.1871 | B.62 | C.9 |
| 1.1872 | B.63 | C.9 |
| 1.1873 | B.64 | C.9 |
| 1.1874 | B.65 | C.9 |
| 1.1875 | B.66 | C.9 |
| 1.1876 | B.67 | C.9 |
| 1.1877 | B.68 | C.9 |
| 1.1878 | B.69 | C.9 |
| 1.1879 | B.70 | C.9 |

TABLE 1-continued (compositions 1.1 to 1.3635):

| comp. no. | herbicide B | safener C |
|---|---|---|
| 1.1880 | B.71 | C.9 |
| 1.1881 | B.72 | C.9 |
| 1.1882 | B.73 | C.9 |
| 1.1883 | B.74 | C.9 |
| 1.1884 | B.75 | C.9 |
| 1.1885 | B.76 | C.9 |
| 1.1886 | B.77 | C.9 |
| 1.1887 | B.78 | C.9 |
| 1.1888 | B.79 | C.9 |
| 1.1889 | B.80 | C.9 |
| 1.1890 | B.81 | C.9 |
| 1.1891 | B.82 | C.9 |
| 1.1892 | B.83 | C.9 |
| 1.1893 | B.84 | C.9 |
| 1.1894 | B.85 | C.9 |
| 1.1895 | B.86 | C.9 |
| 1.1896 | B.87 | C.9 |
| 1.1897 | B.88 | C.9 |
| 1.1898 | B.89 | C.9 |
| 1.1899 | B.90 | C.9 |
| 1.1900 | B.91 | C.9 |
| 1.1901 | B.92 | C.9 |
| 1.1902 | B.93 | C.9 |
| 1.1903 | B.94 | C.9 |
| 1.1904 | B.95 | C.9 |
| 1.1905 | B.96 | C.9 |
| 1.1906 | B.97 | C.9 |
| 1.1907 | B.98 | C.9 |
| 1.1908 | B.99 | C.9 |
| 1.1909 | B.100 | C.9 |
| 1.1910 | B.101 | C.9 |
| 1.1911 | B.102 | C.9 |
| 1.1912 | B.103 | C.9 |
| 1.1913 | B.104 | C.9 |
| 1.1914 | B.105 | C.9 |
| 1.1915 | B.106 | C.9 |
| 1.1916 | B.107 | C.9 |
| 1.1917 | B.108 | C.9 |
| 1.1918 | B.109 | C.9 |
| 1.1919 | B.110 | C.9 |
| 1.1920 | B.111 | C.9 |
| 1.1921 | B.112 | C.9 |
| 1.1922 | B.113 | C.9 |
| 1.1923 | B.114 | C.9 |
| 1.1924 | B.115 | C.9 |
| 1.1925 | B.116 | C.9 |
| 1.1926 | B.117 | C.9 |
| 1.1927 | B.118 | C.9 |
| 1.1928 | B.119 | C.9 |
| 1.1929 | B.120 | C.9 |
| 1.1930 | B.121 | C.9 |
| 1.1931 | B.122 | C.9 |
| 1.1932 | B.123 | C.9 |
| 1.1933 | B.124 | C.9 |
| 1.1934 | B.125 | C.9 |
| 1.1935 | B.126 | C.9 |
| 1.1936 | B.127 | C.9 |
| 1.1937 | B.128 | C.9 |
| 1.1938 | B.129 | C.9 |
| 1.1939 | B.130 | C.9 |
| 1.1940 | B.131 | C.9 |
| 1.1941 | B.132 | C.9 |
| 1.1942 | B.133 | C.9 |
| 1.1943 | B.134 | C.9 |
| 1.1944 | B.135 | C.9 |
| 1.1945 | B.136 | C.9 |
| 1.1946 | B.137 | C.9 |
| 1.1947 | B.138 | C.9 |
| 1.1948 | B.139 | C.9 |
| 1.1949 | B.140 | C.9 |
| 1.1950 | B.141 | C.9 |
| 1.1951 | B.142 | C.9 |
| 1.1952 | B.143 | C.9 |
| 1.1953 | B.144 | C.9 |
| 1.1954 | B.145 | C.9 |
| 1.1955 | B.146 | C.9 |
| 1.1956 | B.147 | C.9 |
| 1.1957 | B.148 | C.9 |
| 1.1958 | B.149 | C.9 |
| 1.1959 | B.150 | C.9 |
| 1.1960 | B.151 | C.9 |
| 1.1961 | B.152 | C.9 |
| 1.1962 | B.153 | C.9 |
| 1.1963 | B.154 | C.9 |
| 1.1964 | B.155 | C.9 |
| 1.1965 | B.156 | C.9 |
| 1.1966 | B.157 | C.9 |
| 1.1967 | B.158 | C.9 |
| 1.1968 | B.159 | C.9 |
| 1.1969 | B.160 | C.9 |
| 1.1970 | B.161 | C.9 |
| 1.1971 | B.162 | C.9 |
| 1.1972 | B.163 | C.9 |
| 1.1973 | B.164 | C.9 |
| 1.1974 | B.165 | C.9 |
| 1.1975 | B.166 | C.9 |
| 1.1976 | B.167 | C.9 |
| 1.1977 | B.168 | C.9 |
| 1.1978 | B.169 | C.9 |
| 1.1979 | B.170 | C.9 |
| 1.1980 | B.171 | C.9 |
| 1.1981 | B.172 | C.9 |
| 1.1982 | B.173 | C.9 |
| 1.1983 | B.174 | C.9 |
| 1.1984 | B.175 | C.9 |
| 1.1985 | B.176 | C.9 |
| 1.1986 | B.177 | C.9 |
| 1.1987 | B.178 | C.9 |
| 1.1988 | B.179 | C.9 |
| 1.1989 | B.180 | C.9 |
| 1.1990 | B.181 | C.9 |
| 1.1991 | B.182 | C.9 |
| 1.1992 | B.183 | C.9 |
| 1.1993 | B.184 | C.9 |
| 1.1994 | B.185 | C.9 |
| 1.1995 | B.186 | C.9 |
| 1.1996 | B.187 | C.9 |
| 1.1997 | B.188 | C.9 |
| 1.1998 | B.189 | C.9 |
| 1.1999 | B.190 | C.9 |
| 1.2000 | B.191 | C.9 |
| 1.2001 | B.192 | C.9 |
| 1.2002 | B.193 | C.9 |
| 1.2003 | B.194 | C.9 |
| 1.2004 | B.195 | C.9 |
| 1.2005 | B.196 | C.9 |
| 1.2006 | B.197 | C.9 |
| 1.2007 | B.198 | C.9 |
| 1.2008 | B.199 | C.9 |
| 1.2009 | B.200 | C.9 |
| 1.2010 | B.201 | C.9 |
| 1.2011 | B.1 | C.10 |
| 1.2012 | B.2 | C.10 |
| 1.2013 | B.3 | C.10 |
| 1.2014 | B.4 | C.10 |
| 1.2015 | B.5 | C.10 |
| 1.2016 | B.6 | C.10 |
| 1.2017 | B.7 | C.10 |
| 1.2018 | B.8 | C.10 |
| 1.2019 | B.9 | C.10 |
| 1.2020 | B.10 | C.10 |
| 1.2021 | B.11 | C.10 |
| 1.2022 | B.12 | C.10 |
| 1.2023 | B.13 | C.10 |
| 1.2024 | B.14 | C.10 |
| 1.2025 | B.15 | C.10 |
| 1.2026 | B.16 | C.10 |
| 1.2027 | B.17 | C.10 |
| 1.2028 | B.18 | C.10 |
| 1.2029 | B.19 | C.10 |

TABLE 1-continued (compositions 1.1 to 1.3635):

| comp. no. | herbicide B | safener C |
|---|---|---|
| 1.2030 | B.20 | C.10 |
| 1.2031 | B.21 | C.10 |
| 1.2032 | B.22 | C.10 |
| 1.2033 | B.23 | C.10 |
| 1.2034 | B.24 | C.10 |
| 1.2035 | B.25 | C.10 |
| 1.2036 | B.26 | C.10 |
| 1.2037 | B.27 | C.10 |
| 1.2038 | B.28 | C.10 |
| 1.2039 | B.29 | C.10 |
| 1.2040 | B.30 | C.10 |
| 1.2041 | B.31 | C.10 |
| 1.2042 | B.32 | C.10 |
| 1.2043 | B.33 | C.10 |
| 1.2044 | B.34 | C.10 |
| 1.2045 | B.35 | C.10 |
| 1.2046 | B.36 | C.10 |
| 1.2047 | B.37 | C.10 |
| 1.2048 | B.38 | C.10 |
| 1.2049 | B.39 | C.10 |
| 1.2050 | B.40 | C.10 |
| 1.2051 | B.41 | C.10 |
| 1.2052 | B.42 | C.10 |
| 1.2053 | B.43 | C.10 |
| 1.2054 | B.44 | C.10 |
| 1.2055 | B.45 | C.10 |
| 1.2056 | B.46 | C.10 |
| 1.2057 | B.47 | C.10 |
| 1.2058 | B.48 | C.10 |
| 1.2059 | B.49 | C.10 |
| 1.2060 | B.50 | C.10 |
| 1.2061 | B.51 | C.10 |
| 1.2062 | B.52 | C.10 |
| 1.2063 | B.53 | C.10 |
| 1.2064 | B.54 | C.10 |
| 1.2065 | B.55 | C.10 |
| 1.2066 | B.56 | C.10 |
| 1.2067 | B.57 | C.10 |
| 1.2068 | B.58. | C.10 |
| 1.2069 | B.59 | C.10 |
| 1.2070 | B.60 | C.10 |
| 1.2071 | B.61 | C.10 |
| 1.2072 | B.62 | C.10 |
| 1.2073 | B.63 | C.10 |
| 1.2074 | B.64 | C.10 |
| 1.2075 | B.65 | C.10 |
| 1.2076 | B.66 | C.10 |
| 1.2077 | B.67 | C.10 |
| 1.2078 | B.68 | C.10 |
| 1.2079 | B.69 | C.10 |
| 1.2080 | B.70 | C.10 |
| 1.2081 | B.71 | C.10 |
| 1.2082 | B.72 | C.10 |
| 1.2083 | B.73 | C.10 |
| 1.2084 | B.74 | C.10 |
| 1.2085 | B.75 | C.10 |
| 1.2086 | B.76 | C.10 |
| 1.2087 | B.77 | C.10 |
| 1.2088 | B.78 | C.10 |
| 1.2089 | B.79 | C.10 |
| 1.2090 | B.80 | C.10 |
| 1.2091 | B.81 | C.10 |
| 1.2092 | B.82 | C.10 |
| 1.2093 | B.83 | C.10 |
| 1.2094 | B.84 | C.10 |
| 1.2095 | B.85 | C.10 |
| 1.2096 | B.86 | C.10 |
| 1.2097 | B.87 | C.10 |
| 1.2098 | B.88 | C.10 |
| 1.2099 | B.89 | C.10 |
| 1.2100 | B.90 | C.10 |
| 1.2101 | B.91 | C.10 |
| 1.2102 | B.92 | C.10 |
| 1.2103 | B.93 | C.10 |
| 1.2104 | B.94 | C.10 |
| 1.2105 | B.95 | C.10 |
| 1.2106 | B.96 | C.10 |
| 1.2107 | B.97 | C.10 |
| 1.2108 | B.98 | C.10 |
| 1.2109 | B.99 | C.10 |
| 1.2110 | B.100 | C.10 |
| 1.2111 | B.101 | C.10 |
| 1.2112 | B.102 | C.10 |
| 1.2113 | B.103 | C.10 |
| 1.2114 | B.104 | C.10 |
| 1.2115 | B.105 | C.10 |
| 1.2116 | B.106 | C.10 |
| 1.2117 | B.107 | C.10 |
| 1.2118 | B.108 | C.10 |
| 1.2119 | B.109 | C.10 |
| 1.2120 | B.110 | C.10 |
| 1.2121 | B.111 | C.10 |
| 1.2122 | B.112 | C.10 |
| 1.2123 | B.113 | C.10 |
| 1.2124 | B.114 | C.10 |
| 1.2125 | B.115 | C.10 |
| 1.2126 | B.116 | C.10 |
| 1.2127 | B.117 | C.10 |
| 1.2128 | B.118 | C.10 |
| 1.2129 | B.119 | C.10 |
| 1.2130 | B.120 | C.10 |
| 1.2131 | B.121 | C.10 |
| 1.2132 | B.122 | C.10 |
| 1.2133 | B.123 | C.10 |
| 1.2134 | B.124 | C.10 |
| 1.2135 | B.125 | C.10 |
| 1.2136 | B.126 | C.10 |
| 1.2137 | B.127 | C.10 |
| 1.2138 | B.128 | C.10 |
| 1.2139 | B.129 | C.10 |
| 1.2140 | B.130 | C.10 |
| 1.2141 | B.131 | C.10 |
| 1.2142 | B.132 | C.10 |
| 1.2143 | B.133 | C.10 |
| 1.2144 | B.134 | C.10 |
| 1.2145 | B.135 | C.10 |
| 1.2146 | B.136 | C.10 |
| 1.2147 | B.137 | C.10 |
| 1.2148 | B.138 | C.10 |
| 1.2149 | B.139 | C.10 |
| 1.2150 | B.140 | C.10 |
| 1.2151 | B.141 | C.10 |
| 1.2152 | B.142 | C.10 |
| 1.2153 | B.143 | C.10 |
| 1.2154 | B.144 | C.10 |
| 1.2155 | B.145 | C.10 |
| 1.2156 | B.146 | C.10 |
| 1.2157 | B.147 | C.10 |
| 1.2158 | B.148 | C.10 |
| 1.2159 | B.149 | C.10 |
| 1.2160 | B.150 | C.10 |
| 1.2161 | B.151 | C.10 |
| 1.2162 | B.152 | C.10 |
| 1.2163 | B.153 | C.10 |
| 1.2164 | B.154 | C.10 |
| 1.2165 | B.155 | C.10 |
| 1.2166 | B.156 | C.10 |
| 1.2167 | B.157 | C.10 |
| 1.2168 | B.158 | C.10 |
| 1.2169 | B.159 | C.10 |
| 1.2170 | B.160 | C.10 |
| 1.2171 | B.161 | C.10 |
| 1.2172 | B.162 | C.10 |
| 1.2173 | B.163 | C.10 |
| 1.2174 | B.164 | C.10 |
| 1.2175 | B.165 | C.10 |
| 1.2176 | B.166 | C.10 |
| 1.2177 | B.167 | C.10 |
| 1.2178 | B.168 | C.10 |
| 1.2179 | B.169 | C.10 |

TABLE 1-continued (compositions 1.1 to 1.3635):

| comp. no. | herbicide B | safener C |
|---|---|---|
| 1.2180 | B.170 | C.10 |
| 1.2181 | B.171 | C.10 |
| 1.2182 | B.172 | C.10 |
| 1.2183 | B.173 | C.10 |
| 1.2184 | B.174 | C.10 |
| 1.2185 | B.175 | C.10 |
| 1.2186 | B.176 | C.10 |
| 1.2187 | B.177 | C.10 |
| 1.2188 | B.178 | C.10 |
| 1.2189 | B.179 | C.10 |
| 1.2190 | B.180 | C.10 |
| 1.2191 | B.181 | C.10 |
| 1.2192 | B.182 | C.10 |
| 1.2193 | B.183 | C.10 |
| 1.2194 | B.184 | C.10 |
| 1.2195 | B.185 | C.10 |
| 1.2196 | B.186 | C.10 |
| 1.2197 | B.187 | C.10 |
| 1.2198 | B.188 | C.10 |
| 1.2199 | B.189 | C.10 |
| 1.2200 | B.190 | C.10 |
| 1.2201 | B.191 | C.10 |
| 1.2202 | B.192 | C.10 |
| 1.2203 | B.193 | C.10 |
| 1.2204 | B.194 | C.10 |
| 1.2205 | B.195 | C.10 |
| 1.2206 | B.196 | C.10 |
| 1.2207 | B.197 | C.10 |
| 1.2208 | B.198 | C.10 |
| 1.2209 | B.199 | C.10 |
| 1.2210 | B.200 | C.10 |
| 1.2211 | B.201 | C.10 |
| 1.2212 | B.1 | C.11 |
| 1.2213 | B.2 | C.11 |
| 1.2214 | B.3 | C.11 |
| 1.2215 | B.4 | C.11 |
| 1.2216 | B.5 | C.11 |
| 1.2217 | B.6 | C.11 |
| 1.2218 | B.7 | C.11 |
| 1.2219 | B.8 | C.11 |
| 1.2220 | B.9 | C.11 |
| 1.2221 | B.10 | C.11 |
| 1.2222 | B.11 | C.11 |
| 1.2223 | B.12 | C.11 |
| 1.2224 | B.13 | C.11 |
| 1.2225 | B.14 | C.11 |
| 1.2226 | B.15 | C.11 |
| 1.2227 | B.16 | C.11 |
| 1.2228 | B.17 | C.11 |
| 1.2229 | B.18 | C.11 |
| 1.2230 | B.19 | C.11 |
| 1.2231 | B.20 | C.11 |
| 1.2232 | B.21 | C.11 |
| 1.2233 | B.22 | C.11 |
| 1.2234 | B.23 | C.11 |
| 1.2235 | B.24 | C.11 |
| 1.2236 | B.25 | C.11 |
| 1.2237 | B.26 | C.11 |
| 1.2238 | B.27 | C.11 |
| 1.2239 | B.28 | C.11 |
| 1.2240 | B.29 | C.11 |
| 1.2241 | B.30 | C.11 |
| 1.2242 | B.31 | C.11 |
| 1.2243 | B.32 | C.11 |
| 1.2244 | B.33 | C.11 |
| 1.2245 | B.34 | C.11 |
| 1.2246 | B.35 | C.11 |
| 1.2247 | B.36 | C.11 |
| 1.2248 | B.37 | C.11 |
| 1.2249 | B.38 | C.11 |
| 1.2250 | B.39 | C.11 |
| 1.2251 | B.40 | C.11 |
| 1.2252 | B.41 | C.11 |
| 1.2253 | B.42 | C.11 |
| 1.2254 | B.43 | C.11 |
| 1.2255 | B.44 | C.11 |
| 1.2256 | B.45 | C.11 |
| 1.2257 | B.46 | C.11 |
| 1.2258 | B.47 | C.11 |
| 1.2259 | B.48 | C.11 |
| 1.2260 | B.49 | C.11 |
| 1.2261 | B.50 | C.11 |
| 1.2262 | B.51 | C.11 |
| 1.2263 | B.52 | C.11 |
| 1.2264 | B.53 | C.11 |
| 1.2265 | B.54 | C.11 |
| 1.2266 | B.55 | C.11 |
| 1.2267 | B.56 | C.11 |
| 1.2268 | B.57 | C.11 |
| 1.2269 | B.58. | C.11 |
| 1.2270 | B.59 | C.11 |
| 1.2271 | B.60 | C.11 |
| 1.2272 | B.61 | C.11 |
| 1.2273 | B.62 | C.11 |
| 1.2274 | B.63 | C.11 |
| 1.2275 | B.64 | C.11 |
| 1.2276 | B.65 | C.11 |
| 1.2277 | B.66 | C.11 |
| 1.2278 | B.67 | C.11 |
| 1.2279 | B.68 | C.11 |
| 1.2280 | B.69 | C.11 |
| 1.2281 | B.70 | C.11 |
| 1.2282 | B.71 | C.11 |
| 1.2283 | B.72 | C.11 |
| 1.2284 | B.73 | C.11 |
| 1.2285 | B.74 | C.11 |
| 1.2286 | B.75 | C.11 |
| 1.2287 | B.76 | C.11 |
| 1.2288 | B.77 | C.11 |
| 1.2289 | B.78 | C.11 |
| 1.2290 | B.79 | C.11 |
| 1.2291 | B.80 | C.11 |
| 1.2292 | B.81 | C.11 |
| 1.2293 | B.82 | C.11 |
| 1.2294 | B.83 | C.11 |
| 1.2295 | B.84 | C.11 |
| 1.2296 | B.85 | C.11 |
| 1.2297 | B.86 | C.11 |
| 1.2298 | B.87 | C.11 |
| 1.2299 | B.88 | C.11 |
| 1.2300 | B.89 | C.11 |
| 1.2301 | B.90 | C.11 |
| 1.2302 | B.91 | C.11 |
| 1.2303 | B.92 | C.11 |
| 1.2304 | B.93 | C.11 |
| 1.2305 | B.94 | C.11 |
| 1.2306 | B.95 | C.11 |
| 1.2307 | B.96 | C.11 |
| 1.2308 | B.97 | C.11 |
| 1.2309 | B.98 | C.11 |
| 1.2310 | B.99 | C.11 |
| 1.2311 | B.100 | C.11 |
| 1.2312 | B.101 | C.11 |
| 1.2313 | B.102 | C.11 |
| 1.2314 | B.103 | C.11 |
| 1.2315 | B.104 | C.11 |
| 1.2316 | B.105 | C.11 |
| 1.2317 | B.106 | C.11 |
| 1.2318 | B.107 | C.11 |
| 1.2319 | B.108 | C.11 |
| 1.2320 | B.109 | C.11 |
| 1.2321 | B.110 | C.11 |
| 1.2322 | B.111 | C.11 |
| 1.2323 | B.112 | C.11 |
| 1.2324 | B.113 | C.11 |
| 1.2325 | B.114 | C.11 |
| 1.2326 | B.115 | C.11 |
| 1.2327 | B.116 | C.11 |
| 1.2328 | B.117 | C.11 |
| 1.2329 | B.118 | C.11 |

TABLE 1-continued (compositions 1.1 to 1.3635):

| comp. no. | herbicide B | safener C |
|---|---|---|
| 1.2330 | B.119 | C.11 |
| 1.2331 | B.120 | C.11 |
| 1.2332 | B.121 | C.11 |
| 1.2333 | B.122 | C.11 |
| 1.2334 | B.123 | C.11 |
| 1.2335 | B.124 | C.11 |
| 1.2336 | B.125 | C.11 |
| 1.2337 | B.126 | C.11 |
| 1.2338 | B.127 | C.11 |
| 1.2339 | B.128 | C.11 |
| 1.2340 | B.129 | C.11 |
| 1.2341 | B.130 | C.11 |
| 1.2342 | B.131 | C.11 |
| 1.2343 | B.132 | C.11 |
| 1.2344 | B.133 | C.11 |
| 1.2345 | B.134 | C.11 |
| 1.2346 | B.135 | C.11 |
| 1.2347 | B.136 | C.11 |
| 1.2348 | B.137 | C.11 |
| 1.2349 | B.138 | C.11 |
| 1.2350 | B.139 | C.11 |
| 1.2351 | B.140 | C.11 |
| 1.2352 | B.141 | C.11 |
| 1.2353 | B.142 | C.11 |
| 1.2354 | B.143 | C.11 |
| 1.2355 | B.144 | C.11 |
| 1.2356 | B.145 | C.11 |
| 1.2357 | B.146 | C.11 |
| 1.2358 | B.147 | C.11 |
| 1.2359 | B.148 | C.11 |
| 1.2360 | B.149 | C.11 |
| 1.2361 | B.150 | C.11 |
| 1.2362 | B.151 | C.11 |
| 1.2363 | B.152 | C.11 |
| 1.2364 | B.153 | C.11 |
| 1.2365 | B.154 | C.11 |
| 1.2366 | B.155 | C.11 |
| 1.2367 | B.156 | C.11 |
| 1.2368 | B.157 | C.11 |
| 1.2369 | B.158 | C.11 |
| 1.2370 | B.159 | C.11 |
| 1.2371 | B.160 | C.11 |
| 1.2372 | B.161 | C.11 |
| 1.2373 | B.162 | C.11 |
| 1.2374 | B.163 | C.11 |
| 1.2375 | B.164 | C.11 |
| 1.2376 | B.165 | C.11 |
| 1.2377 | B.166 | C.11 |
| 1.2378 | B.167 | C.11 |
| 1.2379 | B.168 | C.11 |
| 1.2380 | B.169 | C.11 |
| 1.2381 | B.170 | C.11 |
| 1.2382 | B.171 | C.11 |
| 1.2383 | B.172 | C.11 |
| 1.2384 | B.173 | C.11 |
| 1.2385 | B.174 | C.11 |
| 1.2386 | B.175 | C.11 |
| 1.2387 | B.176 | C.11 |
| 1.2388 | B.177 | C.11 |
| 1.2389 | B.178 | C.11 |
| 1.2390 | B.179 | C.11 |
| 1.2391 | B.180 | C.11 |
| 1.2392 | B.181 | C.11 |
| 1.2393 | B.182 | C.11 |
| 1.2394 | B.183 | C.11 |
| 1.2395 | B.184 | C.11 |
| 1.2396 | B.185 | C.11 |
| 1.2397 | B.186 | C.11 |
| 1.2398 | B.187 | C.11 |
| 1.2399 | B.188 | C.11 |
| 1.2400 | B.189 | C.11 |
| 1.2401 | B.190 | C.11 |
| 1.2402 | B.191 | C.11 |
| 1.2403 | B.192 | C.11 |
| 1.2404 | B.193 | C.11 |
| 1.2405 | B.194 | C.11 |
| 1.2406 | B.195 | C.11 |
| 1.2407 | B.196 | C.11 |
| 1.2408 | B.197 | C.11 |
| 1.2409 | B.198 | C.11 |
| 1.2410 | B.199 | C.11 |
| 1.2411 | B.200 | C.11 |
| 1.2412 | B.201 | C.11 |
| 1.2413 | B.1 | C.12 |
| 1.2414 | B.2 | C.12 |
| 1.2415 | B.3 | C.12 |
| 1.2416 | B.4 | C.12 |
| 1.2417 | B.5 | C.12 |
| 1.2418 | B.6 | C.12 |
| 1.2419 | B.7 | C.12 |
| 1.2420 | B.8 | C.12 |
| 1.2421 | B.9 | C.12 |
| 1.2422 | B.10 | C.12 |
| 1.2423 | B.11 | C.12 |
| 1.2424 | B.12 | C.12 |
| 1.2425 | B.13 | C.12 |
| 1.2426 | B.14 | C.12 |
| 1.2427 | B.15 | C.12 |
| 1.2428 | B.16 | C.12 |
| 1.2429 | B.17 | C.12 |
| 1.2430 | B.18 | C.12 |
| 1.2431 | B.19 | C.12 |
| 1.2432 | B.20 | C.12 |
| 1.2433 | B.21 | C.12 |
| 1.2434 | B.22 | C.12 |
| 1.2435 | B.23 | C.12 |
| 1.2436 | B.24 | C.12 |
| 1.2437 | B.25 | C.12 |
| 1.2438 | B.26 | C.12 |
| 1.2439 | B.27 | C.12 |
| 1.2440 | B.28 | C.12 |
| 1.2441 | B.29 | C.12 |
| 1.2442 | B.30 | C.12 |
| 1.2443 | B.31 | C.12 |
| 1.2444 | B.32 | C.12 |
| 1.2445 | B.33 | C.12 |
| 1.2446 | B.34 | C.12 |
| 1.2447 | B.35 | C.12 |
| 1.2448 | B.36 | C.12 |
| 1.2449 | B.37 | C.12 |
| 1.2450 | B.38 | C.12 |
| 1.2451 | B.39 | C.12 |
| 1.2452 | B.40 | C.12 |
| 1.2453 | B.41 | C.12 |
| 1.2454 | B.42 | C.12 |
| 1.2455 | B.43 | C.12 |
| 1.2456 | B.44 | C.12 |
| 1.2457 | B.45 | C.12 |
| 1.2458 | B.46 | C.12 |
| 1.2459 | B.47 | C.12 |
| 1.2460 | B.48 | C.12 |
| 1.2461 | B.49 | C.12 |
| 1.2462 | B.50 | C.12 |
| 1.2463 | B.51 | C.12 |
| 1.2464 | B.52 | C.12 |
| 1.2465 | B.53 | C.12 |
| 1.2466 | B.54 | C.12 |
| 1.2467 | B.55 | C.12 |
| 1.2468 | B.56 | C.12 |
| 1.2469 | B.57 | C.12 |
| 1.2470 | B.58. | C.12 |
| 1.2471 | B.59 | C.12 |
| 1.2472 | B.60 | C.12 |
| 1.2473 | B.61 | C.12 |
| 1.2474 | B.62 | C.12 |
| 1.2475 | B.63 | C.12 |
| 1.2476 | B.64 | C.12 |
| 1.2477 | B.65 | C.12 |
| 1.2478 | B.66 | C.12 |
| 1.2479 | B.67 | C.12 |

TABLE 1-continued (compositions 1.1 to 1.3635):

| comp. no. | herbicide B | safener C |
|---|---|---|
| 1.2480 | B.68 | C.12 |
| 1.2481 | B.69 | C.12 |
| 1.2482 | B.70 | C.12 |
| 1.2483 | B.71 | C.12 |
| 1.2484 | B.72 | C.12 |
| 1.2485 | B.73 | C.12 |
| 1.2486 | B.74 | C.12 |
| 1.2487 | B.75 | C.12 |
| 1.2488 | B.76 | C.12 |
| 1.2489 | B.77 | C.12 |
| 1.2490 | B.78 | C.12 |
| 1.2491 | B.79 | C.12 |
| 1.2492 | B.80 | C.12 |
| 1.2493 | B.81 | C.12 |
| 1.2494 | B.82 | C.12 |
| 1.2495 | B.83 | C.12 |
| 1.2496 | B.84 | C.12 |
| 1.2497 | B.85 | C.12 |
| 1.2498 | B.86 | C.12 |
| 1.2499 | B.87 | C.12 |
| 1.2500 | B.88 | C.12 |
| 1.2501 | B.89 | C.12 |
| 1.2502 | B.90 | C.12 |
| 1.2503 | B.91 | C.12 |
| 1.2504 | B.92 | C.12 |
| 1.2505 | B.93 | C.12 |
| 1.2506 | B.94 | C.12 |
| 1.2507 | B.95 | C.12 |
| 1.2508 | B.96 | C.12 |
| 1.2509 | B.97 | C.12 |
| 1.2510 | B.98 | C.12 |
| 1.2511 | B.99 | C.12 |
| 1.2512 | B.100 | C.12 |
| 1.2513 | B.101 | C.12 |
| 1.2514 | B.102 | C.12 |
| 1.2515 | B.103 | C.12 |
| 1.2516 | B.104 | C.12 |
| 1.2517 | B.105 | C.12 |
| 1.2518 | B.106 | C.12 |
| 1.2519 | B.107 | C.12 |
| 1.2520 | B.108 | C.12 |
| 1.2521 | B.109 | C.12 |
| 1.2522 | B.110 | C.12 |
| 1.2523 | B.111 | C.12 |
| 1.2524 | B.112 | C.12 |
| 1.2525 | B.113 | C.12 |
| 1.2526 | B.114 | C.12 |
| 1.2527 | B.115 | C.12 |
| 1.2528 | B.116 | C.12 |
| 1.2529 | B.117 | C.12 |
| 1.2530 | B.118 | C.12 |
| 1.2531 | B.119 | C.12 |
| 1.2532 | B.120 | C.12 |
| 1.2533 | B.121 | C.12 |
| 1.2534 | B.122 | C.12 |
| 1.2535 | B.123 | C.12 |
| 1.2536 | B.124 | C.12 |
| 1.2537 | B.125 | C.12 |
| 1.2538 | B.126 | C.12 |
| 1.2539 | B.127 | C.12 |
| 1.2540 | B.128 | C.12 |
| 1.2541 | B.129 | C.12 |
| 1.2542 | B.130 | C.12 |
| 1.2543 | B.131 | C.12 |
| 1.2544 | B.132 | C.12 |
| 1.2545 | B.133 | C.12 |
| 1.2546 | B.134 | C.12 |
| 1.2547 | B.135 | C.12 |
| 1.2548 | B.136 | C.12 |
| 1.2549 | B.137 | C.12 |
| 1.2550 | B.138 | C.12 |
| 1.2551 | B.139 | C.12 |
| 1.2552 | B.140 | C.12 |
| 1.2553 | B.141 | C.12 |
| 1.2554 | B.142 | C.12 |
| 1.2555 | B.143 | C.12 |
| 1.2556 | B.144 | C.12 |
| 1.2557 | B.145 | C.12 |
| 1.2558 | B.146 | C.12 |
| 1.2559 | B.147 | C.12 |
| 1.2560 | B.148 | C.12 |
| 1.2561 | B.149 | C.12 |
| 1.2562 | B.150 | C.12 |
| 1.2563 | B.151 | C.12 |
| 1.2564 | B.152 | C.12 |
| 1.2565 | B.153 | C.12 |
| 1.2566 | B.154 | C.12 |
| 1.2567 | B.155 | C.12 |
| 1.2568 | B.156 | C.12 |
| 1.2569 | B.157 | C.12 |
| 1.2570 | B.158 | C.12 |
| 1.2571 | B.159 | C.12 |
| 1.2572 | B.160 | C.12 |
| 1.2573 | B.161 | C.12 |
| 1.2574 | B.162 | C.12 |
| 1.2575 | B.163 | C.12 |
| 1.2576 | B.164 | C.12 |
| 1.2577 | B.165 | C.12 |
| 1.2578 | B.166 | C.12 |
| 1.2579 | B.167 | C.12 |
| 1.2580 | B.168 | C.12 |
| 1.2581 | B.169 | C.12 |
| 1.2582 | B.170 | C.12 |
| 1.2583 | B.171 | C.12 |
| 1.2584 | B.172 | C.12 |
| 1.2585 | B.173 | C.12 |
| 1.2586 | B.174 | C.12 |
| 1.2587 | B.175 | C.12 |
| 1.2588 | B.176 | C.12 |
| 1.2589 | B.177 | C.12 |
| 1.2590 | B.178 | C.12 |
| 1.2591 | B.179 | C.12 |
| 1.2592 | B.180 | C.12 |
| 1.2593 | B.181 | C.12 |
| 1.2594 | B.182 | C.12 |
| 1.2595 | B.183 | C.12 |
| 1.2596 | B.184 | C.12 |
| 1.2597 | B.185 | C.12 |
| 1.2598 | B.186 | C.12 |
| 1.2599 | B.187 | C.12 |
| 1.2600 | B.188 | C.12 |
| 1.2601 | B.189 | C.12 |
| 1.2602 | B.190 | C.12 |
| 1.2603 | B.191 | C.12 |
| 1.2604 | B.192 | C.12 |
| 1.2605 | B.193 | C.12 |
| 1.2606 | B.194 | C.12 |
| 1.2607 | B.195 | C.12 |
| 1.2608 | B.196 | C.12 |
| 1.2609 | B.197 | C.12 |
| 1.2610 | B.198 | C.12 |
| 1.2611 | B.199 | C.12 |
| 1.2612 | B.200 | C.12 |
| 1.2613 | B.201 | C.12 |
| 1.2614 | B.1 | C.13 |
| 1.2615 | B.2 | C.13 |
| 1.2616 | B.3 | C.13 |
| 1.2617 | B.4 | C.13 |
| 1.2618 | B.5 | C.13 |
| 1.2619 | B.6 | C.13 |
| 1.2620 | B.7 | C.13 |
| 1.2621 | B.8 | C.13 |
| 1.2622 | B.9 | C.13 |
| 1.2623 | B.10 | C.13 |
| 1.2624 | B.11 | C.13 |
| 1.2625 | B.12 | C.13 |
| 1.2626 | B.13 | C.13 |
| 1.2627 | B.14 | C.13 |
| 1.2628 | B.15 | C.13 |
| 1.2629 | B.16 | C.13 |

TABLE 1-continued (compositions 1.1 to 1.3635):

| comp. no. | herbicide B | safener C |
|---|---|---|
| 1.2630 | B.17 | C.13 |
| 1.2631 | B.18 | C.13 |
| 1.2632 | B.19 | C.13 |
| 1.2633 | B.20 | C.13 |
| 1.2634 | B.21 | C.13 |
| 1.2635 | B.22 | C.13 |
| 1.2636 | B.23 | C.13 |
| 1.2637 | B.24 | C.13 |
| 1.2638 | B.25 | C.13 |
| 1.2639 | B.26 | C.13 |
| 1.2640 | B.27 | C.13 |
| 1.2641 | B.28 | C.13 |
| 1.2642 | B.29 | C.13 |
| 1.2643 | B.30 | C.13 |
| 1.2644 | B.31 | C.13 |
| 1.2645 | B.32 | C.13 |
| 1.2646 | B.33 | C.13 |
| 1.2647 | B.34 | C.13 |
| 1.2648 | B.35 | C.13 |
| 1.2649 | B.36 | C.13 |
| 1.2650 | B.37 | C.13 |
| 1.2651 | B.38 | C.13 |
| 1.2652 | B.39 | C.13 |
| 1.2653 | B.40 | C.13 |
| 1.2654 | B.41 | C.13 |
| 1.2655 | B.42 | C.13 |
| 1.2656 | B.43 | C.13 |
| 1.2657 | B.44 | C.13 |
| 1.2658 | B.45 | C.13 |
| 1.2659 | B.46 | C.13 |
| 1.2660 | B.47 | C.13 |
| 1.2661 | B.48 | C.13 |
| 1.2662 | B.49 | C.13 |
| 1.2663 | B.50 | C.13 |
| 1.2664 | B.51 | C.13 |
| 1.2665 | B.52 | C.13 |
| 1.2666 | B.53 | C.13 |
| 1.2667 | B.54 | C.13 |
| 1.2668 | B.55 | C.13 |
| 1.2669 | B.56 | C.13 |
| 1.2670 | B.57 | C.13 |
| 1.2671 | B.58. | C.13 |
| 1.2672 | B.59 | C.13 |
| 1.2673 | B.60 | C.13 |
| 1.2674 | B.61 | C.13 |
| 1.2675 | B.62 | C.13 |
| 1.2676 | B.63 | C.13 |
| 1.2677 | B.64 | C.13 |
| 1.2678 | B.65 | C.13 |
| 1.2679 | B.66 | C.13 |
| 1.2680 | B.67 | C.13 |
| 1.2681 | B.68 | C.13 |
| 1.2682 | B.69 | C.13 |
| 1.2683 | B.70 | C.13 |
| 1.2684 | B.71 | C.13 |
| 1.2685 | B.72 | C.13 |
| 1.2686 | B.73 | C.13 |
| 1.2687 | B.74 | C.13 |
| 1.2688 | B.75 | C.13 |
| 1.2689 | B.76 | C.13 |
| 1.2690 | B.77 | C.13 |
| 1.2691 | B.78 | C.13 |
| 1.2692 | B.79 | C.13 |
| 1.2693 | B.80 | C.13 |
| 1.2694 | B.81 | C.13 |
| 1.2695 | B.82 | C.13 |
| 1.2696 | B.83 | C.13 |
| 1.2697 | B.84 | C.13 |
| 1.2698 | B.85 | C.13 |
| 1.2699 | B.86 | C.13 |
| 1.2700 | B.87 | C.13 |
| 1.2701 | B.88 | C.13 |
| 1.2702 | B.89 | C.13 |
| 1.2703 | B.90 | C.13 |
| 1.2704 | B.91 | C.13 |
| 1.2705 | B.92 | C.13 |
| 1.2706 | B.93 | C.13 |
| 1.2707 | B.94 | C.13 |
| 1.2708 | B.95 | C.13 |
| 1.2709 | B.96 | C.13 |
| 1.2710 | B.97 | C.13 |
| 1.2711 | B.98 | C.13 |
| 1.2712 | B.99 | C.13 |
| 1.2713 | B.100 | C.13 |
| 1.2714 | B.101 | C.13 |
| 1.2715 | B.102 | C.13 |
| 1.2716 | B.103 | C.13 |
| 1.2717 | B.104 | C.13 |
| 1.2718 | B.105 | C.13 |
| 1.2719 | B.106 | C.13 |
| 1.2720 | B.107 | C.13 |
| 1.2721 | B.108 | C.13 |
| 1.2722 | B.109 | C.13 |
| 1.2723 | B.110 | C.13 |
| 1.2724 | B.111 | C.13 |
| 1.2725 | B.112 | C.13 |
| 1.2726 | B.113 | C.13 |
| 1.2727 | B.114 | C.13 |
| 1.2728 | B.115 | C.13 |
| 1.2729 | B.116 | C.13 |
| 1.2730 | B.117 | C.13 |
| 1.2731 | B.118 | C.13 |
| 1.2732 | B.119 | C.13 |
| 1.2733 | B.120 | C.13 |
| 1.2734 | B.121 | C.13 |
| 1.2735 | B.122 | C.13 |
| 1.2736 | B.123 | C.13 |
| 1.2737 | B.124 | C.13 |
| 1.2738 | B.125 | C.13 |
| 1.2739 | B.126 | C.13 |
| 1.2740 | B.127 | C.13 |
| 1.2741 | B.128 | C.13 |
| 1.2742 | B.129 | C.13 |
| 1.2743 | B.130 | C.13 |
| 1.2744 | B.131 | C.13 |
| 1.2745 | B.132 | C.13 |
| 1.2746 | B.133 | C.13 |
| 1.2747 | B.134 | C.13 |
| 1.2748 | B.135 | C.13 |
| 1.2749 | B.136 | C.13 |
| 1.2750 | B.137 | C.13 |
| 1.2751 | B.138 | C.13 |
| 1.2752 | B.139 | C.13 |
| 1.2753 | B.140 | C.13 |
| 1.2754 | B.141 | C.13 |
| 1.2755 | B.142 | C.13 |
| 1.2756 | B.143 | C.13 |
| 1.2757 | B.144 | C.13 |
| 1.2758 | B.145 | C.13 |
| 1.2759 | B.146 | C.13 |
| 1.2760 | B.147 | C.13 |
| 1.2761 | B.148 | C.13 |
| 1.2762 | B.149 | C.13 |
| 1.2763 | B.150 | C.13 |
| 1.2764 | B.151 | C.13 |
| 1.2765 | B.152 | C.13 |
| 1.2766 | B.153 | C.13 |
| 1.2767 | B.154 | C.13 |
| 1.2768 | B.155 | C.13 |
| 1.2769 | B.156 | C.13 |
| 1.2770 | B.157 | C.13 |
| 1.2771 | B.158 | C.13 |
| 1.2772 | B.159 | C.13 |
| 1.2773 | B.160 | C.13 |
| 1.2774 | B.161 | C.13 |
| 1.2775 | B.162 | C.13 |
| 1.2776 | B.163 | C.13 |
| 1.2777 | B.164 | C.13 |
| 1.2778 | B.165 | C.13 |
| 1.2779 | B.166 | C.13 |

TABLE 1-continued (compositions 1.1 to 1.3635):

| comp. no. | herbicide B | safener C |
|---|---|---|
| 1.2780 | B.167 | C.13 |
| 1.2781 | B.168 | C.13 |
| 1.2782 | B.169 | C.13 |
| 1.2783 | B.170 | C.13 |
| 1.2784 | B.171 | C.13 |
| 1.2785 | B.172 | C.13 |
| 1.2786 | B.173 | C.13 |
| 1.2787 | B.174 | C.13 |
| 1.2788 | B.175 | C.13 |
| 1.2789 | B.176 | C.13 |
| 1.2790 | B.177 | C.13 |
| 1.2791 | B.178 | C.13 |
| 1.2792 | B.179 | C.13 |
| 1.2793 | B.180 | C.13 |
| 1.2794 | B.181 | C.13 |
| 1.2795 | B.182 | C.13 |
| 1.2796 | B.183 | C.13 |
| 1.2797 | B.184 | C.13 |
| 1.2798 | B.185 | C.13 |
| 1.2799 | B.186 | C.13 |
| 1.2800 | B.187 | C.13 |
| 1.2801 | B.188 | C.13 |
| 1.2802 | B.189 | C.13 |
| 1.2803 | B.190 | C.13 |
| 1.2804 | B.191 | C.13 |
| 1.2805 | B.192 | C.13 |
| 1.2806 | B.193 | C.13 |
| 1.2807 | B.194 | C.13 |
| 1.2808 | B.195 | C.13 |
| 1.2809 | B.196 | C.13 |
| 1.2810 | B.197 | C.13 |
| 1.2811 | B.198 | C.13 |
| 1.2812 | B.199 | C.13 |
| 1.2813 | B.200 | C.13 |
| 1.2814 | B.201 | C.13 |
| 1.2815 | B.1 | C.14 |
| 1.2816 | B.2 | C.14 |
| 1.2817 | B.3 | C.14 |
| 1.2818 | B.4 | C.14 |
| 1.2819 | B.5 | C.14 |
| 1.2820 | B.6 | C.14 |
| 1.2821 | B.7 | C.14 |
| 1.2822 | B.8 | C.14 |
| 1.2823 | B.9 | C.14 |
| 1.2824 | B.10 | C.14 |
| 1.2825 | B.11 | C.14 |
| 1.2826 | B.12 | C.14 |
| 1.2827 | B.13 | C.14 |
| 1.2828 | B.14 | C.14 |
| 1.2829 | B.15 | C.14 |
| 1.2830 | B.16 | C.14 |
| 1.2831 | B.17 | C.14 |
| 1.2832 | B.18 | C.14 |
| 1.2833 | B.19 | C.14 |
| 1.2834 | B.20 | C.14 |
| 1.2835 | B.21 | C.14 |
| 1.2836 | B.22 | C.14 |
| 1.2837 | B.23 | C.14 |
| 1.2838 | B.24 | C.14 |
| 1.2839 | B.25 | C.14 |
| 1.2840 | B.26 | C.14 |
| 1.2841 | B.27 | C.14 |
| 1.2842 | B.28 | C.14 |
| 1.2843 | B.29 | C.14 |
| 1.2844 | B.30 | C.14 |
| 1.2845 | B.31 | C.14 |
| 1.2846 | B.32 | C.14 |
| 1.2847 | B.33 | C.14 |
| 1.2848 | B.34 | C.14 |
| 1.2849 | B.35 | C.14 |
| 1.2850 | B.36 | C.14 |
| 1.2851 | B.37 | C.14 |
| 1.2852 | B.38 | C.14 |
| 1.2853 | B.39 | C.14 |
| 1.2854 | B.40 | C.14 |
| 1.2855 | B.41 | C.14 |
| 1.2856 | B.42 | C.14 |
| 1.2857 | B.43 | C.14 |
| 1.2858 | B.44 | C.14 |
| 1.2859 | B.45 | C.14 |
| 1.2860 | B.46 | C.14 |
| 1.2861 | B.47 | C.14 |
| 1.2862 | B.48 | C.14 |
| 1.2863 | B.49 | C.14 |
| 1.2864 | B.50 | C.14 |
| 1.2865 | B.51 | C.14 |
| 1.2866 | B.52 | C.14 |
| 1.2867 | B.53 | C.14 |
| 1.2868 | B.54 | C.14 |
| 1.2869 | B.55 | C.14 |
| 1.2870 | B.56 | C.14 |
| 1.2871 | B.57 | C.14 |
| 1.2872 | B.58. | C.14 |
| 1.2873 | B.59 | C.14 |
| 1.2874 | B.60 | C.14 |
| 1.2875 | B.61 | C.14 |
| 1.2876 | B.62 | C.14 |
| 1.2877 | B.63 | C.14 |
| 1.2878 | B.64 | C.14 |
| 1.2879 | B.65 | C.14 |
| 1.2880 | B.66 | C.14 |
| 1.2881 | B.67 | C.14 |
| 1.2882 | B.68 | C.14 |
| 1.2883 | B.69 | C.14 |
| 1.2884 | B.70 | C.14 |
| 1.2885 | B.71 | C.14 |
| 1.2886 | B.72 | C.14 |
| 1.2887 | B.73 | C.14 |
| 1.2888 | B.74 | C.14 |
| 1.2889 | B.75 | C.14 |
| 1.2890 | B.76 | C.14 |
| 1.2891 | B.77 | C.14 |
| 1.2892 | B.78 | C.14 |
| 1.2893 | B.79 | C.14 |
| 1.2894 | B.80 | C.14 |
| 1.2895 | B.81 | C.14 |
| 1.2896 | B.82 | C.14 |
| 1.2897 | B.83 | C.14 |
| 1.2898 | B.84 | C.14 |
| 1.2899 | B.85 | C.14 |
| 1.2900 | B.86 | C.14 |
| 1.2901 | B.87 | C.14 |
| 1.2902 | B.88 | C.14 |
| 1.2903 | B.89 | C.14 |
| 1.2904 | B.90 | C.14 |
| 1.2905 | B.91 | C.14 |
| 1.2906 | B.92 | C.14 |
| 1.2907 | B.93 | C.14 |
| 1.2908 | B.94 | C.14 |
| 1.2909 | B.95 | C.14 |
| 1.2910 | B.96 | C.14 |
| 1.2911 | B.97 | C.14 |
| 1.2912 | B.98 | C.14 |
| 1.2913 | B.99 | C.14 |
| 1.2914 | B.100 | C.14 |
| 1.2915 | B.101 | C.14 |
| 1.2916 | B.102 | C.14 |
| 1.2917 | B.103 | C.14 |
| 1.2918 | B.104 | C.14 |
| 1.2919 | B.105 | C.14 |
| 1.2920 | B.106 | C.14 |
| 1.2921 | B.107 | C.14 |
| 1.2922 | B.108 | C.14 |
| 1.2923 | B.109 | C.14 |
| 1.2924 | B.110 | C.14 |
| 1.2925 | B.111 | C.14 |
| 1.2926 | B.112 | C.14 |
| 1.2927 | B.113 | C.14 |
| 1.2928 | B.114 | C.14 |
| 1.2929 | B.115 | C.14 |

TABLE 1-continued (compositions 1.1 to 1.3635):

| comp. no. | herbicide B | safener C |
|---|---|---|
| 1.2930 | B.116 | C.14 |
| 1.2931 | B.117 | C.14 |
| 1.2932 | B.118 | C.14 |
| 1.2933 | B.119 | C.14 |
| 1.2934 | B.120 | C.14 |
| 1.2935 | B.121 | C.14 |
| 1.2936 | B.122 | C.14 |
| 1.2937 | B.123 | C.14 |
| 1.2938 | B.124 | C.14 |
| 1.2939 | B.125 | C.14 |
| 1.2940 | B.126 | C.14 |
| 1.2941 | B.127 | C.14 |
| 1.2942 | B.128 | C.14 |
| 1.2943 | B.129 | C.14 |
| 1.2944 | B.130 | C.14 |
| 1.2945 | B.131 | C.14 |
| 1.2946 | B.132 | C.14 |
| 1.2947 | B.133 | C.14 |
| 1.2948 | B.134 | C.14 |
| 1.2949 | B.135 | C.14 |
| 1.2950 | B.136 | C.14 |
| 1.2951 | B.137 | C.14 |
| 1.2952 | B.138 | C.14 |
| 1.2953 | B.139 | C.14 |
| 1.2954 | B.140 | C.14 |
| 1.2955 | B.141 | C.14 |
| 1.2956 | B.142 | C.14 |
| 1.2957 | B.143 | C.14 |
| 1.2958 | B.144 | C.14 |
| 1.2959 | B.145 | C.14 |
| 1.2960 | B.146 | C.14 |
| 1.2961 | B.147 | C.14 |
| 1.2962 | B.148 | C.14 |
| 1.2963 | B.149 | C.14 |
| 1.2964 | B.150 | C.14 |
| 1.2965 | B.151 | C.14 |
| 1.2966 | B.152 | C.14 |
| 1.2967 | B.153 | C.14 |
| 1.2968 | B.154 | C.14 |
| 1.2969 | B.155 | C.14 |
| 1.2970 | B.156 | C.14 |
| 1.2971 | B.157 | C.14 |
| 1.2972 | B.158 | C.14 |
| 1.2973 | B.159 | C.14 |
| 1.2974 | B.160 | C.14 |
| 1.2975 | B.161 | C.14 |
| 1.2976 | B.162 | C.14 |
| 1.2977 | B.163 | C.14 |
| 1.2978 | B.164 | C.14 |
| 1.2979 | B.165 | C.14 |
| 1.2980 | B.166 | C.14 |
| 1.2981 | B.167 | C.14 |
| 1.2982 | B.168 | C.14 |
| 1.2983 | B.169 | C.14 |
| 1.2984 | B.170 | C.14 |
| 1.2985 | B.171 | C.14 |
| 1.2986 | B.172 | C.14 |
| 1.2987 | B.173 | C.14 |
| 1.2988 | B.174 | C.14 |
| 1.2989 | B.175 | C.14 |
| 1.2990 | B.176 | C.14 |
| 1.2991 | B.177 | C.14 |
| 1.2992 | B.178 | C.14 |
| 1.2993 | B.179 | C.14 |
| 1.2994 | B.180 | C.14 |
| 1.2995 | B.181 | C.14 |
| 1.2996 | B.182 | C.14 |
| 1.2997 | B.183 | C.14 |
| 1.2998 | B.184 | C.14 |
| 1.2999 | B.185 | C.14 |
| 1.3000 | B.186 | C.14 |
| 1.3001 | B.187 | C.14 |
| 1.3002 | B.188 | C.14 |
| 1.3003 | B.189 | C.14 |
| 1.3004 | B.190 | C.14 |
| 1.3005 | B.191 | C.14 |
| 1.3006 | B.192 | C.14 |
| 1.3007 | B.193 | C.14 |
| 1.3008 | B.194 | C.14 |
| 1.3009 | B.195 | C.14 |
| 1.3010 | B.196 | C.14 |
| 1.3011 | B.197 | C.14 |
| 1.3012 | B.198 | C.14 |
| 1.3013 | B.199 | C.14 |
| 1.3014 | B.200 | C.14 |
| 1.3015 | B.201 | C.14 |
| 1.3016 | B.1 | C.15 |
| 1.3017 | B.2 | C.15 |
| 1.3018 | B.3 | C.15 |
| 1.3019 | B.4 | C.15 |
| 1.3020 | B.5 | C.15 |
| 1.3021 | B.6 | C.15 |
| 1.3022 | B.7 | C.15 |
| 1.3023 | B.8 | C.15 |
| 1.3024 | B.9 | C.15 |
| 1.3025 | B.10 | C.15 |
| 1.3026 | B.11 | C.15 |
| 1.3027 | B.12 | C.15 |
| 1.3028 | B.13 | C.15 |
| 1.3029 | B.14 | C.15 |
| 1.3030 | B.15 | C.15 |
| 1.3031 | B.16 | C.15 |
| 1.3032 | B.17 | C.15 |
| 1.3033 | B.18 | C.15 |
| 1.3034 | B.19 | C.15 |
| 1.3035 | B.20 | C.15 |
| 1.3036 | B.21 | C.15 |
| 1.3037 | B.22 | C.15 |
| 1.3038 | B.23 | C.15 |
| 1.3039 | B.24 | C.15 |
| 1.3040 | B.25 | C.15 |
| 1.3041 | B.26 | C.15 |
| 1.3042 | B.27 | C.15 |
| 1.3043 | B.28 | C.15 |
| 1.3044 | B.29 | C.15 |
| 1.3045 | B.30 | C.15 |
| 1.3046 | B.31 | C.15 |
| 1.3047 | B.32 | C.15 |
| 1.3048 | B.33 | C.15 |
| 1.3049 | B.34 | C.15 |
| 1.3050 | B.35 | C.15 |
| 1.3051 | B.36 | C.15 |
| 1.3052 | B.37 | C.15 |
| 1.3053 | B.38 | C.15 |
| 1.3054 | B.39 | C.15 |
| 1.3055 | B.40 | C.15 |
| 1.3056 | B.41 | C.15 |
| 1.3057 | B.42 | C.15 |
| 1.3058 | B.43 | C.15 |
| 1.3059 | B.44 | C.15 |
| 1.3060 | B.45 | C.15 |
| 1.3061 | B.46 | C.15 |
| 1.3062 | B.47 | C.15 |
| 1.3063 | B.48 | C.15 |
| 1.3064 | B.49 | C.15 |
| 1.3065 | B.50 | C.15 |
| 1.3066 | B.51 | C.15 |
| 1.3067 | B.52 | C.15 |
| 1.3068 | B.53 | C.15 |
| 1.3069 | B.54 | C.15 |
| 1.3070 | B.55 | C.15 |
| 1.3071 | B.56 | C.15 |
| 1.3072 | B.57 | C.15 |
| 1.3073 | B.58. | C.15 |
| 1.3074 | B.59 | C.15 |
| 1.3075 | B.60 | C.15 |
| 1.3076 | B.61 | C.15 |
| 1.3077 | B.62 | C.15 |
| 1.3078 | B.63 | C.15 |
| 1.3079 | B.64 | C.15 |

TABLE 1-continued (compositions 1.1 to 1.3635):

| comp. no. | herbicide B | safener C |
|---|---|---|
| 1.3080 | B.65 | C.15 |
| 1.3081 | B.66 | C.15 |
| 1.3082 | B.67 | C.15 |
| 1.3083 | B.68 | C.15 |
| 1.3084 | B.69 | C.15 |
| 1.3085 | B.70 | C.15 |
| 1.3086 | B.71 | C.15 |
| 1.3087 | B.72 | C.15 |
| 1.3088 | B.73 | C.15 |
| 1.3089 | B.74 | C.15 |
| 1.3090 | B.75 | C.15 |
| 1.3091 | B.76 | C.15 |
| 1.3092 | B.77 | C.15 |
| 1.3093 | B.78 | C.15 |
| 1.3094 | B.79 | C.15 |
| 1.3095 | B.80 | C.15 |
| 1.3096 | B.81 | C.15 |
| 1.3097 | B.82 | C.15 |
| 1.3098 | B.83 | C.15 |
| 1.3099 | B.84 | C.15 |
| 1.3100 | B.85 | C.15 |
| 1.3101 | B.86 | C.15 |
| 1.3102 | B.87 | C.15 |
| 1.3103 | B.88 | C.15 |
| 1.3104 | B.89 | C.15 |
| 1.3105 | B.90 | C.15 |
| 1.3106 | B.91 | C.15 |
| 1.3107 | B.92 | C.15 |
| 1.3108 | B.93 | C.15 |
| 1.3109 | B.94 | C.15 |
| 1.3110 | B.95 | C.15 |
| 1.3111 | B.96 | C.15 |
| 1.3112 | B.97 | C.15 |
| 1.3113 | B.98 | C.15 |
| 1.3114 | B.99 | C.15 |
| 1.3115 | B.100 | C.15 |
| 1.3116 | B.101 | C.15 |
| 1.3117 | B.102 | C.15 |
| 1.3118 | B.103 | C.15 |
| 1.3119 | B.104 | C.15 |
| 1.3120 | B.105 | C.15 |
| 1.3121 | B.106 | C.15 |
| 1.3122 | B.107 | C.15 |
| 1.3123 | B.108 | C.15 |
| 1.3124 | B.109 | C.15 |
| 1.3125 | B.110 | C.15 |
| 1.3126 | B.111 | C.15 |
| 1.3127 | B.112 | C.15 |
| 1.3128 | B.113 | C.15 |
| 1.3129 | B.114 | C.15 |
| 1.3130 | B.115 | C.15 |
| 1.3131 | B.116 | C.15 |
| 1.3132 | B.117 | C.15 |
| 1.3133 | B.118 | C.15 |
| 1.3134 | B.119 | C.15 |
| 1.3135 | B.120 | C.15 |
| 1.3136 | B.121 | C.15 |
| 1.3137 | B.122 | C.15 |
| 1.3138 | B.123 | C.15 |
| 1.3139 | B.124 | C.15 |
| 1.3140 | B.125 | C.15 |
| 1.3141 | B.126 | C.15 |
| 1.3142 | B.127 | C.15 |
| 1.3143 | B.128 | C.15 |
| 1.3144 | B.129 | C.15 |
| 1.3145 | B.130 | C.15 |
| 1.3146 | B.131 | C.15 |
| 1.3147 | B.132 | C.15 |
| 1.3148 | B.133 | C.15 |
| 1.3149 | B.134 | C.15 |
| 1.3150 | B.135 | C.15 |
| 1.3151 | B.136 | C.15 |
| 1.3152 | B.137 | C.15 |
| 1.3153 | B.138 | C.15 |
| 1.3154 | B.139 | C.15 |
| 1.3155 | B.140 | C.15 |
| 1.3156 | B.141 | C.15 |
| 1.3157 | B.142 | C.15 |
| 1.3158 | B.143 | C.15 |
| 1.3159 | B.144 | C.15 |
| 1.3160 | B.145 | C.15 |
| 1.3161 | B.146 | C.15 |
| 1.3162 | B.147 | C.15 |
| 1.3163 | B.148 | C.15 |
| 1.3164 | B.149 | C.15 |
| 1.3165 | B.150 | C.15 |
| 1.3166 | B.151 | C.15 |
| 1.3167 | B.152 | C.15 |
| 1.3168 | B.153 | C.15 |
| 1.3169 | B.154 | C.15 |
| 1.3170 | B.155 | C.15 |
| 1.3171 | B.156 | C.15 |
| 1.3172 | B.157 | C.15 |
| 1.3173 | B.158 | C.15 |
| 1.3174 | B.159 | C.15 |
| 1.3175 | B.160 | C.15 |
| 1.3176 | B.161 | C.15 |
| 1.3177 | B.162 | C.15 |
| 1.3178 | B.163 | C.15 |
| 1.3179 | B.164 | C.15 |
| 1.3180 | B.165 | C.15 |
| 1.3181 | B.166 | C.15 |
| 1.3182 | B.167 | C.15 |
| 1.3183 | B.168 | C.15 |
| 1.3184 | B.169 | C.15 |
| 1.3185 | B.170 | C.15 |
| 1.3186 | B.171 | C.15 |
| 1.3187 | B.172 | C.15 |
| 1.3188 | B.173 | C.15 |
| 1.3189 | B.174 | C.15 |
| 1.3190 | B.175 | C.15 |
| 1.3191 | B.176 | C.15 |
| 1.3192 | B.177 | C.15 |
| 1.3193 | B.178 | C.15 |
| 1.3194 | B.179 | C.15 |
| 1.3195 | B.180 | C.15 |
| 1.3196 | B.181 | C.15 |
| 1.3197 | B.182 | C.15 |
| 1.3198 | B.183 | C.15 |
| 1.3199 | B.184 | C.15 |
| 1.3200 | B.185 | C.15 |
| 1.3201 | B.186 | C.15 |
| 1.3202 | B.187 | C.15 |
| 1.3203 | B.188 | C.15 |
| 1.3204 | B.189 | C.15 |
| 1.3205 | B.190 | C.15 |
| 1.3206 | B.191 | C.15 |
| 1.3207 | B.192 | C.15 |
| 1.3208 | B.193 | C.15 |
| 1.3209 | B.194 | C.15 |
| 1.3210 | B.195 | C.15 |
| 1.3211 | B.196 | C.15 |
| 1.3212 | B.197 | C.15 |
| 1.3213 | B.198 | C.15 |
| 1.3214 | B.199 | C.15 |
| 1.3215 | B.200 | C.15 |
| 1.3216 | B.201 | C.15 |
| 1.3217 | B.1 | C.16 |
| 1.3218 | B.2 | C.16 |
| 1.3219 | B.3 | C.16 |
| 1.3220 | B.4 | C.16 |
| 1.3221 | B.5 | C.16 |
| 1.3222 | B.6 | C.16 |
| 1.3223 | B.7 | C.16 |
| 1.3224 | B.8 | C.16 |
| 1.3225 | B.9 | C.16 |
| 1.3226 | B.10 | C.16 |
| 1.3227 | B.11 | C.16 |
| 1.3228 | B.12 | C.16 |
| 1.3229 | B.13 | C.16 |

TABLE 1-continued (compositions 1.1 to 1.3635):

| comp. no. | herbicide B | safener C |
|---|---|---|
| 1.3230 | B.14 | C.16 |
| 1.3231 | B.15 | C.16 |
| 1.3232 | B.16 | C.16 |
| 1.3233 | B.17 | C.16 |
| 1.3234 | B.18 | C.16 |
| 1.3235 | B.19 | C.16 |
| 1.3236 | B.20 | C.16 |
| 1.3237 | B.21 | C.16 |
| 1.3238 | B.22 | C.16 |
| 1.3239 | B.23 | C.16 |
| 1.3240 | B.24 | C.16 |
| 1.3241 | B.25 | C.16 |
| 1.3242 | B.26 | C.16 |
| 1.3243 | B.27 | C.16 |
| 1.3244 | B.28 | C.16 |
| 1.3245 | B.29 | C.16 |
| 1.3246 | B.30 | C.16 |
| 1.3247 | B.31 | C.16 |
| 1.3248 | B.32 | C.16 |
| 1.3249 | B.33 | C.16 |
| 1.3250 | B.34 | C.16 |
| 1.3251 | B.35 | C.16 |
| 1.3252 | B.36 | C.16 |
| 1.3253 | B.37 | C.16 |
| 1.3254 | B.38 | C.16 |
| 1.3255 | B.39 | C.16 |
| 1.3256 | B.40 | C.16 |
| 1.3257 | B.41 | C.16 |
| 1.3258 | B.42 | C.16 |
| 1.3259 | B.43 | C.16 |
| 1.3260 | B.44 | C.16 |
| 1.3261 | B.45 | C.16 |
| 1.3262 | B.46 | C.16 |
| 1.3263 | B.47 | C.16 |
| 1.3264 | B.48 | C.16 |
| 1.3265 | B.49 | C.16 |
| 1.3266 | B.50 | C.16 |
| 1.3267 | B.51 | C.16 |
| 1.3268 | B.52 | C.16 |
| 1.3269 | B.53 | C.16 |
| 1.3270 | B.54 | C.16 |
| 1.3271 | B.55 | C.16 |
| 1.3272 | B.56 | C.16 |
| 1.3273 | B.57 | C.16 |
| 1.3274 | B.58. | C.16 |
| 1.3275 | B.59 | C.16 |
| 1.3276 | B.60 | C.16 |
| 1.3277 | B.61 | C.16 |
| 1.3278 | B.62 | C.16 |
| 1.3279 | B.63 | C.16 |
| 1.3280 | B.64 | C.16 |
| 1.3281 | B.65 | C.16 |
| 1.3282 | B.66 | C.16 |
| 1.3283 | B.67 | C.16 |
| 1.3284 | B.68 | C.16 |
| 1.3285 | B.69 | C.16 |
| 1.3286 | B.70 | C.16 |
| 1.3287 | B.71 | C.16 |
| 1.3288 | B.72 | C.16 |
| 1.3289 | B.73 | C.16 |
| 1.3290 | B.74 | C.16 |
| 1.3291 | B.75 | C.16 |
| 1.3292 | B.76 | C.16 |
| 1.3293 | B.77 | C.16 |
| 1.3294 | B.78 | C.16 |
| 1.3295 | B.79 | C.16 |
| 1.3296 | B.80 | C.16 |
| 1.3297 | B.81 | C.16 |
| 1.3298 | B.82 | C.16 |
| 1.3299 | B.83 | C.16 |
| 1.3300 | B.84 | C.16 |
| 1.3301 | B.85 | C.16 |
| 1.3302 | B.86 | C.16 |
| 1.3303 | B.87 | C.16 |
| 1.3304 | B.88 | C.16 |
| 1.3305 | B.89 | C.16 |
| 1.3306 | B.90 | C.16 |
| 1.3307 | B.91 | C.16 |
| 1.3308 | B.92 | C.16 |
| 1.3309 | B.93 | C.16 |
| 1.3310 | B.94 | C.16 |
| 1.3311 | B.95 | C.16 |
| 1.3312 | B.96 | C.16 |
| 1.3313 | B.97 | C.16 |
| 1.3314 | B.98 | C.16 |
| 1.3315 | B.99 | C.16 |
| 1.3316 | B.100 | C.16 |
| 1.3317 | B.101 | C.16 |
| 1.3318 | B.102 | C.16 |
| 1.3319 | B.103 | C.16 |
| 1.3320 | B.104 | C.16 |
| 1.3321 | B.105 | C.16 |
| 1.3322 | B.106 | C.16 |
| 1.3323 | B.107 | C.16 |
| 1.3324 | B.108 | C.16 |
| 1.3325 | B.109 | C.16 |
| 1.3326 | B.110 | C.16 |
| 1.3327 | B.111 | C.16 |
| 1.3328 | B.112 | C.16 |
| 1.3329 | B.113 | C.16 |
| 1.3330 | B.114 | C.16 |
| 1.3331 | B.115 | C.16 |
| 1.3332 | B.116 | C.16 |
| 1.3333 | B.117 | C.16 |
| 1.3334 | B.118 | C.16 |
| 1.3335 | B.119 | C.16 |
| 1.3336 | B.120 | C.16 |
| 1.3337 | B.121 | C.16 |
| 1.3338 | B.122 | C.16 |
| 1.3339 | B.123 | C.16 |
| 1.3340 | B.124 | C.16 |
| 1.3341 | B.125 | C.16 |
| 1.3342 | B.126 | C.16 |
| 1.3343 | B.127 | C.16 |
| 1.3344 | B.128 | C.16 |
| 1.3345 | B.129 | C.16 |
| 1.3346 | B.130 | C.16 |
| 1.3347 | B.131 | C.16 |
| 1.3348 | B.132 | C.16 |
| 1.3349 | B.133 | C.16 |
| 1.3350 | B.134 | C.16 |
| 1.3351 | B.135 | C.16 |
| 1.3352 | B.136 | C.16 |
| 1.3353 | B.137 | C.16 |
| 1.3354 | B.138 | C.16 |
| 1.3355 | B.139 | C.16 |
| 1.3356 | B.140 | C.16 |
| 1.3357 | B.141 | C.16 |
| 1.3358 | B.142 | C.16 |
| 1.3359 | B.143 | C.16 |
| 1.3360 | B.144 | C.16 |
| 1.3361 | B.145 | C.16 |
| 1.3362 | B.146 | C.16 |
| 1.3363 | B.147 | C.16 |
| 1.3364 | B.148 | C.16 |
| 1.3365 | B.149 | C.16 |
| 1.3366 | B.150 | C.16 |
| 1.3367 | B.151 | C.16 |
| 1.3368 | B.152 | C.16 |
| 1.3369 | B.153 | C.16 |
| 1.3370 | B.154 | C.16 |
| 1.3371 | B.155 | C.16 |
| 1.3372 | B.156 | C.16 |
| 1.3373 | B.157 | C.16 |
| 1.3374 | B.158 | C.16 |
| 1.3375 | B.159 | C.16 |
| 1.3376 | B.160 | C.16 |
| 1.3377 | B.161 | C.16 |
| 1.3378 | B.162 | C.16 |
| 1.3379 | B.163 | C.16 |

TABLE 1-continued (compositions 1.1 to 1.3635):

| comp. no. | herbicide B | safener C |
|---|---|---|
| 1.3380 | B.164 | C.16 |
| 1.3381 | B.165 | C.16 |
| 1.3382 | B.166 | C.16 |
| 1.3383 | B.167 | C.16 |
| 1.3384 | B.168 | C.16 |
| 1.3385 | B.169 | C.16 |
| 1.3386 | B.170 | C.16 |
| 1.3387 | B.171 | C.16 |
| 1.3388 | B.172 | C.16 |
| 1.3389 | B.173 | C.16 |
| 1.3390 | B.174 | C.16 |
| 1.3391 | B.175 | C.16 |
| 1.3392 | B.176 | C.16 |
| 1.3393 | B.177 | C.16 |
| 1.3394 | B.178 | C.16 |
| 1.3395 | B.179 | C.16 |
| 1.3396 | B.180 | C.16 |
| 1.3397 | B.181 | C.16 |
| 1.3398 | B.182 | C.16 |
| 1.3399 | B.183 | C.16 |
| 1.3400 | B.184 | C.16 |
| 1.3401 | B.185 | C.16 |
| 1.3402 | B.186 | C.16 |
| 1.3403 | B.187 | C.16 |
| 1.3404 | B.188 | C.16 |
| 1.3405 | B.189 | C.16 |
| 1.3406 | B.190 | C.16 |
| 1.3407 | B.191 | C.16 |
| 1.3408 | B.192 | C.16 |
| 1.3409 | B.193 | C.16 |
| 1.3410 | B.194 | C.16 |
| 1.3411 | B.195 | C.16 |
| 1.3412 | B.196 | C.16 |
| 1.3413 | B.197 | C.16 |
| 1.3414 | B.198 | C.16 |
| 1.3415 | B.199 | C.16 |
| 1.3416 | B.200 | C.16 |
| 1.3417 | B.201 | C.16 |
| 1.3418 | B.1 | C.17 |
| 1.3419 | B.2 | C.17 |
| 1.3420 | B.3 | C.17 |
| 1.3421 | B.4 | C.17 |
| 1.3422 | B.5 | C.17 |
| 1.3423 | B.6 | C.17 |
| 1.3424 | B.7 | C.17 |
| 1.3425 | B.8 | C.17 |
| 1.3426 | B.9 | C.17 |
| 1.3427 | B.10 | C.17 |
| 1.3428 | B.11 | C.17 |
| 1.3429 | B.12 | C.17 |
| 1.3430 | B.13 | C.17 |
| 1.3431 | B.14 | C.17 |
| 1.3432 | B.15 | C.17 |
| 1.3433 | B.16 | C.17 |
| 1.3434 | B.17 | C.17 |
| 1.3435 | B.18 | C.17 |
| 1.3436 | B.19 | C.17 |
| 1.3437 | B.20 | C.17 |
| 1.3438 | B.21 | C.17 |
| 1.3439 | B.22 | C.17 |
| 1.3440 | B.23 | C.17 |
| 1.3441 | B.24 | C.17 |
| 1.3442 | B.25 | C.17 |
| 1.3443 | B.26 | C.17 |
| 1.3444 | B.27 | C.17 |
| 1.3445 | B.28 | C.17 |
| 1.3446 | B.29 | C.17 |
| 1.3447 | B.30 | C.17 |
| 1.3448 | B.31 | C.17 |
| 1.3449 | B.32 | C.17 |
| 1.3450 | B.33 | C.17 |
| 1.3451 | B.34 | C.17 |
| 1.3452 | B.35 | C.17 |
| 1.3453 | B.36 | C.17 |
| 1.3454 | B.37 | C.17 |
| 1.3455 | B.38 | C.17 |
| 1.3456 | B.39 | C.17 |
| 1.3457 | B.40 | C.17 |
| 1.3458 | B.41 | C.17 |
| 1.3459 | B.42 | C.17 |
| 1.3460 | B.43 | C.17 |
| 1.3461 | B.44 | C.17 |
| 1.3462 | B.45 | C.17 |
| 1.3463 | B.46 | C.17 |
| 1.3464 | B.47 | C.17 |
| 1.3465 | B.48 | C.17 |
| 1.3466 | B.49 | C.17 |
| 1.3467 | B.50 | C.17 |
| 1.3468 | B.51 | C.17 |
| 1.3469 | B.52 | C.17 |
| 1.3470 | B.53 | C.17 |
| 1.3471 | B.54 | C.17 |
| 1.3472 | B.55 | C.17 |
| 1.3473 | B.56 | C.17 |
| 1.3474 | B.57 | C.17 |
| 1.3475 | B.58. | C.17 |
| 1.3476 | B.59 | C.17 |
| 1.3477 | B.60 | C.17 |
| 1.3478 | B.61 | C.17 |
| 1.3479 | B.62 | C.17 |
| 1.3480 | B.63 | C.17 |
| 1.3481 | B.64 | C.17 |
| 1.3482 | B.65 | C.17 |
| 1.3483 | B.66 | C.17 |
| 1.3484 | B.67 | C.17 |
| 1.3485 | B.68 | C.17 |
| 1.3486 | B.69 | C.17 |
| 1.3487 | B.70 | C.17 |
| 1.3488 | B.71 | C.17 |
| 1.3489 | B.72 | C.17 |
| 1.3490 | B.73 | C.17 |
| 1.3491 | B.74 | C.17 |
| 1.3492 | B.75 | C.17 |
| 1.3493 | B.76 | C.17 |
| 1.3494 | B.77 | C.17 |
| 1.3495 | B.78 | C.17 |
| 1.3496 | B.79 | C.17 |
| 1.3497 | B.80 | C.17 |
| 1.3498 | B.81 | C.17 |
| 1.3499 | B.82 | C.17 |
| 1.3500 | B.83 | C.17 |
| 1.3501 | B.84 | C.17 |
| 1.3502 | B.85 | C.17 |
| 1.3503 | B.86 | C.17 |
| 1.3504 | B.87 | C.17 |
| 1.3505 | B.88 | C.17 |
| 1.3506 | B.89 | C.17 |
| 1.3507 | B.90 | C.17 |
| 1.3508 | B.91 | C.17 |
| 1.3509 | B.92 | C.17 |
| 1.3510 | B.93 | C.17 |
| 1.3511 | B.94 | C.17 |
| 1.3512 | B.95 | C.17 |
| 1.3513 | B.96 | C.17 |
| 1.3514 | B.97 | C.17 |
| 1.3515 | B.98 | C.17 |
| 1.3516 | B.99 | C.17 |
| 1.3517 | B.100 | C.17 |
| 1.3518 | B.101 | C.17 |
| 1.3519 | B.102 | C.17 |
| 1.3520 | B.103 | C.17 |
| 1.3521 | B.104 | C.17 |
| 1.3522 | B.105 | C.17 |
| 1.3523 | B.106 | C.17 |
| 1.3524 | B.107 | C.17 |
| 1.3525 | B.108 | C.17 |
| 1.3526 | B.109 | C.17 |
| 1.3527 | B.110 | C.17 |
| 1.3528 | B.111 | C.17 |
| 1.3529 | B.112 | C.17 |

TABLE 1-continued (compositions 1.1 to 1.3635):

| comp. no. | herbicide B | safener C |
|---|---|---|
| 1.3530 | B.113 | C.17 |
| 1.3531 | B.114 | C.17 |
| 1.3532 | B.115 | C.17 |
| 1.3533 | B.116 | C.17 |
| 1.3534 | B.117 | C.17 |
| 1.3535 | B.118 | C.17 |
| 1.3536 | B.119 | C.17 |
| 1.3537 | B.120 | C.17 |
| 1.3538 | B.121 | C.17 |
| 1.3539 | B.122 | C.17 |
| 1.3540 | B.123 | C.17 |
| 1.3541 | B.124 | C.17 |
| 1.3542 | B.125 | C.17 |
| 1.3543 | B.126 | C.17 |
| 1.3544 | B.127 | C.17 |
| 1.3545 | B.128 | C.17 |
| 1.3546 | B.129 | C.17 |
| 1.3547 | B.130 | C.17 |
| 1.3548 | B.131 | C.17 |
| 1.3549 | B.132 | C.17 |
| 1.3550 | B.133 | C.17 |
| 1.3551 | B.134 | C.17 |
| 1.3552 | B.135 | C.17 |
| 1.3553 | B.136 | C.17 |
| 1.3554 | B.137 | C.17 |
| 1.3555 | B.138 | C.17 |
| 1.3556 | B.139 | C.17 |
| 1.3557 | B.140 | C.17 |
| 1.3558 | B.141 | C.17 |
| 1.3559 | B.142 | C.17 |
| 1.3560 | B.143 | C.17 |
| 1.3561 | B.144 | C.17 |
| 1.3562 | B.145 | C.17 |
| 1.3563 | B.146 | C.17 |
| 1.3564 | B.147 | C.17 |
| 1.3565 | B.148 | C.17 |
| 1.3566 | B.149 | C.17 |
| 1.3567 | B.150 | C.17 |
| 1.3568 | B.151 | C.17 |
| 1.3569 | B.152 | C.17 |
| 1.3570 | B.153 | C.17 |
| 1.3571 | B.154 | C.17 |
| 1.3572 | B.155 | C.17 |
| 1.3573 | B.156 | C.17 |
| 1.3574 | B.157 | C.17 |
| 1.3575 | B.158 | C.17 |
| 1.3576 | B.159 | C.17 |
| 1.3577 | B.160 | C.17 |
| 1.3578 | B.161 | C.17 |
| 1.3579 | B.162 | C.17 |
| 1.3580 | B.163 | C.17 |
| 1.3581 | B.164 | C.17 |
| 1.3582 | B.165 | C.17 |
| 1.3583 | B.166 | C.17 |
| 1.3584 | B.167 | C.17 |
| 1.3585 | B.168 | C.17 |
| 1.3586 | B.169 | C.17 |
| 1.3587 | B.170 | C.17 |
| 1.3588 | B.171 | C.17 |
| 1.3589 | B.172 | C.17 |
| 1.3590 | B.173 | C.17 |
| 1.3591 | B.174 | C.17 |
| 1.3592 | B.175 | C.17 |
| 1.3593 | B.176 | C.17 |
| 1.3594 | B.177 | C.17 |
| 1.3595 | B.178 | C.17 |
| 1.3596 | B.179 | C.17 |
| 1.3597 | B.180 | C.17 |
| 1.3598 | B.181 | C.17 |
| 1.3599 | B.182 | C.17 |
| 1.3600 | B.183 | C.17 |
| 1.3601 | B.184 | C.17 |
| 1.3602 | B.185 | C.17 |
| 1.3603 | B.186 | C.17 |
| 1.3604 | B.187 | C.17 |
| 1.3605 | B.188 | C.17 |
| 1.3606 | B.189 | C.17 |
| 1.3607 | B.190 | C.17 |
| 1.3608 | B.191 | C.17 |
| 1.3609 | B.192 | C.17 |
| 1.3610 | B.193 | C.17 |
| 1.3611 | B.194 | C.17 |
| 1.3612 | B.195 | C.17 |
| 1.3613 | B.196 | C.17 |
| 1.3614 | B.197 | C.17 |
| 1.3615 | B.198 | C.17 |
| 1.3616 | B.199 | C.17 |
| 1.3617 | B.200 | C.17 |
| 1.3618 | B.201 | C.17 |
| 1.3619 | — | C.1 |
| 1.3620 | — | C.2 |
| 1.3621 | — | C.3 |
| 1.3622 | — | C.4 |
| 1.3623 | — | C.5 |
| 1.3624 | — | C.6 |
| 1.3625 | — | C.7 |
| 1.3626 | — | C.8 |
| 1.3627 | — | C.9 |
| 1.3628 | — | C.10 |
| 1.3629 | — | C.11 |
| 1.3630 | — | C.12 |
| 1.3631 | — | C.13 |
| 1.3632 | — | C.14 |
| 1.3633 | — | C.15 |
| 1.3634 | — | C.16 |
| 1.3635 | — | C.17 |
| 1.3636 | B.202 | — |
| 1.3637 | B.202 | C.1 |
| 1.3638 | B.202 | C.2 |
| 1.3639 | B.202 | C.3 |
| 1.3640 | B.202 | C.4 |
| 1.3641 | B.202 | C.5 |
| 1.3642 | B.202 | C.6 |
| 1.3643 | B.202 | C.7 |
| 1.3644 | B.202 | C.8 |
| 1.3645 | B.202 | C.9 |
| 1.3646 | B.202 | C.10 |
| 1.3647 | B.202 | C.11 |
| 1.3648 | B.202 | C.12 |
| 1.3649 | B.202 | C.13 |
| 1.3650 | B.202 | C.14 |
| 1.3651 | B.202 | C.15 |
| 1.3652 | B.202 | C.16 |
| 1.3653 | B.202 | C.17 |

The specific number for each single composition is deductible as follows: Composition 1.200 for example comprises the uracilpyridine I.a.339 and cinmethylin (B.200) (see table 1, entry 1.200; as well as table B, entry B.200).

Composition 2.200 for example comprises the uracilpyridine I.a.109 (see the definition for compositions 2.1 to 2.3653, preferably 2.1 to 2.3635, below) and cinmethylin (B.200) (see table 1, entry 1.200; as well as table B, entry B.200).

Composition 7.200 for example comprises imazapyr (B.35) (see the definition for compositions 7.1 to 7.3653, preferably 7.1 to 7.3635, below), the uracilpyridine I.a.339 and cinmethylin (B.200) (see table 1, entry 1.200; as well as table B, entry B.200).

Also especially preferred are compositions 2.1 to 2.3653, more preferred 2.1. to 2.3635, which differ from the corresponding compositions 1.1 to 1.3653, more preferred 1.1 to 1.3635, only in that they comprise as the active compound A the uracilpyridine of formula (I.a.109).

Also especially preferred are compositions 3.1 to 3.3653, more preferred 3.1. to 3.3635, which differ from the corresponding compositions 1.1 to 1.3653, more preferred 1.1 to 1.3635, only in that they additionally comprise B.2 as further herbicide B.

Also especially preferred are compositions 4.1 to 4.3653, more preferred 4.1. to 4.3635, which differ from the corresponding compositions 1.1 to 1.3653, more preferred 1.1 to 1.3635, only in that they additionally comprise B.8 as further herbicide B.

Also especially preferred are compositions 5.1 to 5.3653, more preferred 5.1. to 5.3635, which differ from the corresponding compositions 1.1 to 1.3653, more preferred 1.1 to 1.3635, only in that they additionally comprise B.30 as further herbicide B.

Also especially preferred are compositions 6.1 to 6.3653, more preferred 6.1. to 6.3635, which differ from the corresponding compositions 1.1 to 1.3653, more preferred 1.1 to 1.3635, only in that they additionally comprise B.32 as further herbicide B.

Also especially preferred are compositions 7.1 to 7.3653, more preferred 7.1. to 7.3635, which differ from the corresponding compositions 1.1 to 1.3653, more preferred 1.1 to 1.3635, only in that they additionally comprise B.35 as further herbicide B.

Also especially preferred are compositions 8.1 to 8.3653, more preferred 8.1. to 8.3635, which differ from the corresponding compositions 1.1 to 1.3653, more preferred 1.1 to 1.3635, only in that they additionally comprise B.38 as further herbicide B.

Also especially preferred are compositions 9.1 to 9.3653, more preferred 9.1. to 9.3635, which differ from the corresponding compositions 1.1 to 1.3653, more preferred 1.1 to 1.3635, only in that they additionally comprise B.40 as further herbicide B.

Also especially preferred are compositions 10.1 to 10.3653, more preferred 10.1. to 10.3635, which differ from the corresponding compositions 1.1 to 1.3653, more preferred 1.1 to 1.3635, only in that they additionally comprise B.51 as further herbicide B.

Also especially preferred are compositions 11.1 to 11.3653, more preferred 11.1. to 11.3635, which differ from the corresponding compositions 1.1 to 1.3653, more preferred 1.1 to 1.3635, only in that they additionally comprise B.55 as further herbicide B.

Also especially preferred are compositions 12.1 to 12.3653, more preferred 12.1. to 12.3635, which differ from the corresponding compositions 1.1 to 1.3653, more preferred 1.1 to 1.3635, only in that they additionally comprise B.56 as further herbicide B.

Also especially preferred are compositions 13.1 to 13.3653, more preferred 13.1. to 13.3635, which differ from the corresponding compositions 1.1 to 1.3653, more preferred 1.1 to 1.3635, only in that they additionally comprise B.64 as further herbicide B.

Also especially preferred are compositions 14.1 to 14.3653, more preferred 14.1. to 14.3635, which differ from the corresponding compositions 1.1 to 1.3653, more preferred 1.1 to 1.3635, only in that they additionally comprise B.66 as further herbicide B.

Also especially preferred are compositions 15.1 to 15.3653, more preferred 15.1. to 15.3635, which differ from the corresponding compositions 1.1 to 1.3653, more preferred 1.1 to 1.3635, only in that they additionally comprise B.67 as further herbicide B.

Also especially preferred are compositions 16.1 to 16.3653, more preferred 16.1. to 16.3635, which differ from the corresponding compositions 1.1 to 1.3653, more preferred 1.1 to 1.3635, only in that they additionally comprise B.68 as further herbicide B.

Also especially preferred are compositions 17.1 to 17.3653, more preferred 17.1. to 17.3635, which differ from the corresponding compositions 1.1 to 1.3653, more preferred 1.1 to 1.3635, only in that they additionally comprise B.69 as further herbicide B.

Also especially preferred are compositions 18.1 to 18.3653, more preferred 18.1. to 18.3635, which differ from the corresponding compositions 1.1 to 1.3653, more preferred 1.1 to 1.3635, only in that they additionally comprise B.73 as further herbicide B.

Also especially preferred are compositions 19.1 to 19.3653, more preferred 19.1. to 19.3635, which differ from the corresponding compositions 1.1 to 1.3653, more preferred 1.1 to 1.3635, only in that they additionally comprise B.76 as further herbicide B.

Also especially preferred are compositions 20.1 to 20.3653, more preferred 20.1. to 20.3635, which differ from the corresponding compositions 1.1 to 1.3653, more preferred 1.1 to 1.3635, only in that they additionally comprise B.81 as further herbicide B.

Also especially preferred are compositions 21.1 to 21.3653, more preferred 21.1. to 21.3635, which differ from the corresponding compositions 1.1 to 1.3653, more preferred 1.1 to 1.3635, only in that they additionally comprise B.82 as further herbicide B.

Also especially preferred are compositions 22.1 to 22.3653, more preferred 22.1. to 22.3635, which differ from the corresponding compositions 1.1 to 1.3653, more preferred 1.1 to 1.3635, only in that they additionally comprise B.85 as further herbicide B.

Also especially preferred are compositions 23.1 to 23.3653, more preferred 23.1. to 23.3635, which differ from the corresponding compositions 1.1 to 1.3653, more preferred 1.1 to 1.3635, only in that they additionally comprise B.88 as further herbicide B.

Also especially preferred are compositions 24.1 to 24.3653, more preferred 24.1. to 24.3635, which differ from the corresponding compositions 1.1 to 1.3653, more preferred 1.1 to 1.3635, only in that they additionally comprise B.89 as further herbicide B.

Also especially preferred are compositions 25.1 to 25.3653, more preferred 25.1. to 25.3635, which differ from the corresponding compositions 1.1 to 1.3653, more preferred 1.1 to 1.3635, only in that they additionally comprise B.94 as further herbicide B.

Also especially preferred are compositions 26.1 to 26.3653, more preferred 26.1. to 26.3635, which differ from the corresponding compositions 1.1 to 1.3653, more preferred 1.1 to 1.3635, only in that they additionally comprise B.95 as further herbicide B.

Also especially preferred are compositions 27.1 to 27.3653, more preferred 27.1. to 27.3635, which differ from the corresponding compositions 1.1 to 1.3653, more preferred 1.1 to 1.3635, only in that they additionally comprise B.98 as further herbicide B.

Also especially preferred are compositions 28.1 to 28.3653, more preferred 28.1. to 28.3635, which differ from the corresponding compositions 1.1 to 1.3653, more preferred 1.1 to 1.3635, only in that they additionally comprise B.100 as further herbicide B.

Also especially preferred are compositions 29.1 to 29.3653, more preferred 29.1. to 29.3635, which differ from the corresponding compositions 1.1 to 1.3653, more preferred 1.1 to 1.3635, only in that they additionally comprise B.103 as further herbicide B.

Also especially preferred are compositions 30.1 to 30.3653, more preferred 30.1. to 30.3635, which differ from the corresponding compositions 1.1 to 1.3653, more preferred 1.1 to 1.3635, only in that they additionally comprise B.103 and B.67 as further herbicides B.

Also especially preferred are compositions 31.1 to 31.3653, more preferred 31.1. to 31.3635, which differ from the corresponding compositions 1.1 to 1.3653, more preferred 1.1 to 1.3635, only in that they additionally comprise B.103 and B.76 as further herbicides B.

Also especially preferred are compositions 32.1 to 32.3653, more preferred 32.1. to 32.3635, which differ from the corresponding compositions 1.1 to 1.3653, more preferred 1.1 to 1.3635, only in that they additionally comprise B.103 and B.82 as further herbicides B.

Also especially preferred are compositions 33.1 to 33.3653, more preferred 33.1. to 33.3635, which differ from the corresponding compositions 1.1 to 1.3653, more preferred 1.1 to 1.3635, only in that they additionally comprise B.104 as further herbicide B.

Also especially preferred are compositions 34.1 to 34.3653, more preferred 34.1. to 34.3635, which differ from the corresponding compositions 1.1 to 1.3653, more preferred 1.1 to 1.3635, only in that they additionally comprise B.104 and B.67 as further herbicides B.

Also especially preferred are compositions 35.1 to 35.3653, more preferred 35.1. to 35.3635, which differ from the corresponding compositions 1.1 to 1.3653, more preferred 1.1 to 1.3635, only in that they additionally comprise B.104 and B.76 as further herbicides B.

Also especially preferred are compositions 36.1 to 36.3653, more preferred 36.1. to 36.3635, which differ from the corresponding compositions 1.1 to 1.3653, more preferred 1.1 to 1.3635, only in that they additionally comprise B.104 and B.82 as further herbicides B.

Also especially preferred are compositions 37.1 to 37.3653, more preferred 37.1. to 37.3635, which differ from the corresponding compositions 1.1 to 1.3653, more preferred 1.1 to 1.3635, only in that they additionally comprise B.106 as further herbicide B.

Also especially preferred are compositions 38.1 to 38.3653, more preferred 38.1. to 38.3635, which differ from the corresponding compositions 1.1 to 1.3653, more preferred 1.1 to 1.3635, only in that they additionally comprise B.107 as further herbicide B.

Also especially preferred are compositions 39.1 to 39.3653, more preferred 39.1. to 39.3635, which differ from the corresponding compositions 1.1 to 1.3653, more preferred 1.1 to 1.3635, only in that they additionally comprise B. 107 and B.67 as further herbicides B.

Also especially preferred are compositions 40.1 to 40.3653, more preferred 40.1. to 40.3635, which differ from the corresponding compositions 1.1 to 1.3653, more preferred 1.1 to 1.3635, only in that they additionally comprise B. 107 and B.76 as further herbicides B.

Also especially preferred are compositions 41.1 to 41.3653, more preferred 41.1. to 41.3635, which differ from the corresponding compositions 1.1 to 1.3653, more preferred 1.1 to 1.3635, only in that they additionally comprise B. 107 and B.82 as further herbicides B.

Also especially preferred are compositions 42.1 to 42.3653, more preferred 42.1. to 42.3635, which differ from the corresponding compositions 1.1 to 1.3653, more preferred 1.1 to 1.3635, only in that they additionally comprise B.109 as further herbicide B.

Also especially preferred are compositions 43.1 to 43.3653, more preferred 43.1. to 43.3635, which differ from the corresponding compositions 1.1 to 1.3653, more preferred 1.1 to 1.3635, only in that they additionally comprise B.111 as further herbicide B.

Also especially preferred are compositions 44.1 to 44.3653, more preferred 44.1. to 44.3635, which differ from the corresponding compositions 1.1 to 1.3653, more preferred 1.1 to 1.3635, only in that they additionally comprise B.111 and B.67 as further herbicides B.

Also especially preferred are compositions 45.1 to 45.3653, more preferred 45.1. to 45.3635, which differ from the corresponding compositions 1.1 to 1.3653, more preferred 1.1 to 1.3635, only in that they additionally comprise B.111 and B.76 as further herbicides B.

Also especially preferred are compositions 46.1 to 46.3653, more preferred 46.1. to 46.3635, which differ from the corresponding compositions 1.1 to 1.3653, more preferred 1.1 to 1.3635, only in that they additionally comprise B.111 and B.82 as further herbicides B.

Also especially preferred are compositions 47.1 to 47.3653, more preferred 47.1. to 47.3635, which differ from the corresponding compositions 1.1 to 1.3653, more preferred 1.1 to 1.3635, only in that they additionally comprise B. 116 as further herbicide B.

Also especially preferred are compositions 48.1 to 48.3653, more preferred 48.1. to 48.3635, which differ from the corresponding compositions 1.1 to 1.3653, more preferred 1.1 to 1.3635, only in that they additionally comprise B.116 and B.67 as further herbicides B.

Also especially preferred are compositions 49.1 to 49.3653, more preferred 49.1. to 49.3635, which differ from the corresponding compositions 1.1 to 1.3653, more preferred 1.1 to 1.3635, only in that they additionally comprise B.116 and B.94 as further herbicides B.

Also especially preferred are compositions 50.1 to 50.3653, more preferred 50.1. to 50.3635, which differ from the corresponding compositions 1.1 to 1.3653, more preferred 1.1 to 1.3635, only in that they additionally comprise B.116 and B.103 as further herbicides B.

Also especially preferred are compositions 51.1 to 51.3653, more preferred 51.1. to 51.3635, which differ from the corresponding compositions 1.1 to 1.3653, more preferred 1.1 to 1.3635, only in that they additionally comprise B.116 and B.128 as further herbicides B.

Also especially preferred are compositions 52.1 to 52.3653, more preferred 52.1. to 52.3635, which differ from the corresponding compositions 1.1 to 1.3653, more preferred 1.1 to 1.3635, only in that they additionally comprise B.116 and B.104 as further herbicides B.

Also especially preferred are compositions 53.1 to 53.3653, more preferred 53.1. to 53.3635, which differ from the corresponding compositions 1.1 to 1.3653, more preferred 1.1 to 1.3635, only in that they additionally comprise B.116 and B.107 as further herbicides B.

Also especially preferred are compositions 54.1 to 54.3653, more preferred 54.1. to 54.3635, which differ from the corresponding compositions 1.1 to 1.3653, more preferred 1.1 to 1.3635, only in that they additionally comprise B.116 and B.111 as further herbicides B.

Also especially preferred are compositions 55.1 to 55.3653, more preferred 55.1. to 55.3635, which differ from the corresponding compositions 1.1 to 1.3653, more preferred 1.1 to 1.3635, only in that they additionally comprise B.122 as further herbicide B.

Also especially preferred are compositions 56.1 to 56.3653, more preferred 56.1. to 56.3635, which differ from the corresponding compositions 1.1 to 1.3653, more preferred 1.1 to 1.3635, only in that they additionally comprise B.126 as further herbicide B.

Also especially preferred are compositions 57.1 to 57.3653, more preferred 57.1. to 57.3635, which differ from the corresponding compositions 1.1 to 1.3653, more preferred 1.1 to 1.3635, only in that they additionally comprise B.128 as further herbicide B.

Also especially preferred are compositions 58.1 to 58.3653, more preferred 58.1. to 58.3635, which differ from the corresponding compositions 1.1 to 1.3653, more preferred 1.1 to 1.3635, only in that they additionally comprise B.131 as further herbicide B.

Also especially preferred are compositions 59.1 to 59.3653, more preferred 59.1. to 59.3635, which differ from the corresponding compositions 1.1 to 1.3653, more preferred 1.1 to 1.3635, only in that they additionally comprise B.132 as further herbicide B.

Also especially preferred are compositions 60.1 to 60.3653, more preferred 60.1. to 60.3635, which differ from the corresponding compositions 1.1 to 1.3653, more preferred 1.1 to 1.3635, only in that they additionally comprise B.133 as further herbicide B.

Also especially preferred are compositions 61.1 to 61.3653, more preferred 61.1. to 61.3635, which differ from the corresponding compositions 1.1 to 1.3653, more preferred 1.1 to 1.3635, only in that they additionally comprise B.135 as further herbicide B.

Also especially preferred are compositions 62.1 to 62.3653, more preferred 62.1. to 62.3635, which differ from the corresponding compositions 1.1 to 1.3653, more preferred 1.1 to 1.3635, only in that they additionally comprise B.137 as further herbicide B.

Also especially preferred are compositions 63.1 to 63.3653, more preferred 63.1. to 63.3635, which differ from the corresponding compositions 1.1 to 1.3653, more preferred 11.1 to 1.3635, only in that they additionally comprise B.138 as further herbicide B.

Also especially preferred are compositions 64.1 to 64.3653, more preferred 64.1. to 64.3635, which differ from the corresponding compositions 1.1 to 1.3653, more preferred 1.1 to 1.3635, only in that they additionally comprise B.140 as further herbicide B.

Also especially preferred are compositions 65.1 to 65.3653, more preferred 65.1. to 65.3635, which differ from the corresponding compositions 1.1 to 1.3653, more preferred 1.1 to 1.3635, only in that they additionally comprise B.145 as further herbicide B.

Also especially preferred are compositions 66.1 to 66.3653, more preferred 66.1. to 66.3635, which differ from the corresponding compositions 1.1 to 1.3653, more preferred 1.1 to 1.3635, only in that they additionally comprise B.153 as further herbicide B.

Also especially preferred are compositions 67.1 to 67.3653, more preferred 67.1. to 67.3635, which differ from the corresponding compositions 1.1 to 1.3653, more preferred 1.1 to 1.3635, only in that they additionally comprise B.156 as further herbicide B.

Also especially preferred are compositions 68.1 to 68.3653, more preferred 68.1. to 68.3635, which differ from the corresponding compositions 1.1 to 1.3653, more preferred 1.1 to 1.3635, only in that they additionally comprise B.171 as further herbicide B.

Also especially preferred are compositions 69.1 to 69.3653, more preferred 69.1. to 69.3635, which differ from the corresponding compositions 1.1 to 1.3653, more preferred 1.1 to 1.3635, only in that they additionally comprise B.174 as further herbicide B.

Also especially preferred are compositions 70.1 to 70.3653, more preferred 70.1. to 70.3635, which differ from the corresponding compositions 1.1 to 1.3653, more preferred 1.1 to 1.3635, only in that they comprise as the active compound A the uracilpyridine of formula (I.a.115).

Also especially preferred are compositions 71.1 to 71.3653, more preferred 71.1. to 71.3635, which differ from the corresponding compositions 1.1 to 1.3653, more preferred 1.1 to 1.3635, only in that they comprise as the active compound A the uracilpyridine of formula (I.a.255).

Also especially preferred are compositions 72.1 to 72.3653, more preferred 72.1. to 72.3635, which differ from the corresponding compositions 1.1 to 1.3653, more preferred 1.1 to 1.3635, only in that they comprise as the active compound A the uracilpyridine of formula (I.a.277).

Also especially preferred are compositions 73.1 to 73.3653, more preferred 73.1. to 73.3635, which differ from the corresponding compositions 1.1 to 1.3653, more preferred 1.1 to 1.3635, only in that they comprise as the active compound A the uracilpyridine of formula (I.a.283).

Also especially preferred are compositions 74.1 to 74.3653, more preferred 74.1. to 74.3635, which differ from the corresponding compositions 1.1 to 1.3653, more preferred 1.1 to 1.3635, only in that they comprise as the active compound A the uracilpyridine of formula (I.a.87).

Also especially preferred are compositions 75.1 to 75.3653, more preferred 75.1. to 75.3635, which differ from the corresponding compositions 1.1 to 1.3653, more preferred 1.1 to 1.3635, only in that they comprise as the active compound A the uracilpyridine of formula (I.a.361).

Also especially preferred are compositions 76.1 to 76.3653, more preferred 76.1. to 76.3635, which differ from the corresponding compositions 1.1 to 1.3653, more preferred 1.1 to 1.3635, only in that they comprise as the active compound A the uracilpyridine of formula (I.a.367).

Also especially preferred are compositions 77.1 to 77.3653, more preferred 77.1. to 77.3635, which differ from the corresponding compositions 1.1 to 1.3653, more preferred 1.1 to 1.3635, only in that they comprise as the active compound A the uracilpyridine of formula (I.h.87).

Also especially preferred are compositions 78.1 to 78.3653, more preferred 78.1. to 78.3635, which differ from the corresponding compositions 1.1 to 1.3653, more preferred 1.1 to 1.3635, only in that they comprise as the active compound A the uracilpyridine of formula (I.h.109).

Also especially preferred are compositions 79.1 to 79.3653, more preferred 79.1. to 79.3635, which differ from the corresponding compositions 1.1 to 1.3653, more preferred 1.1 to 1.3635, only in that they comprise as the active compound A the uracilpyridine of formula (I.h.115).

Also especially preferred are compositions 80.1 to 80.3653, more preferred 80.1. to 80.3635, which differ from the corresponding compositions 1.1 to 1.3653, more preferred 1.1 to 1.3635, only in that they comprise as the active compound A the uracilpyridine of formula (I.h.255).

Also especially preferred are compositions 81.1 to 81.3653, more preferred 81.1. to 81.3635, which differ from the corresponding compositions 1.1 to 1.3653, more preferred 1.1 to 1.3635, only in that they comprise as the active compound A the uracilpyridine of formula (I.h.277).

Also especially preferred are compositions 82.1 to 82.3653, more preferred 82.1. to 82.3635, which differ from the corresponding compositions 1.1 to 1.3653, more preferred 1.1 to 1.3635, only in that they comprise as the active compound A the uracilpyridine of formula (I.h.283).

Also especially preferred are compositions 83.1 to 83.3653, more preferred 83.1. to 83.3635, which differ from the corresponding compositions 1.1 to 1.3653, more preferred 1.1 to 1.3635, only in that they comprise as the active compound A the uracilpyridine of formula (I.h.339).

Also especially preferred are compositions 84.1 to 84.3653, more preferred 84.1. to 84.3635, which differ from the corresponding compositions 1.1 to 1.3653, more preferred 1.1 to 1.3635, only in that they comprise as the active compound A the uracilpyridine of formula (I.h.361).

Also especially preferred are compositions 85.1 to 85.3653, more preferred 85.1. to 85.3635, which differ from the corresponding compositions 1.1 to 1.3653, more preferred 1.1 to 1.3635, only in that they comprise as the active compound A the uracilpyridine of formula (I.h.367).

Also especially preferred are compositions 86.1 to 86.3653, more preferred 86.1. to 86.3635, which differ from the corresponding compositions 1.1 to 1.3653, more preferred 1.1 to 1.3635, only in they comprise as the active compound A the uracilpyridine of formula (I.h.339) and additionally comprise B.2 as further herbicide B.

Also especially preferred are compositions 87.1 to 87.3653, more preferred 87.1. to 87.3635, which differ from the corresponding compositions 1.1 to 1.3653, more preferred 1.1 to 1.3635, only in that they comprise as the active compound A the uracilpyridine of formula (I.h.339) and additionally comprise B.8 as further herbicide B.

Also especially preferred are compositions 88.1 to 88.3653, more preferred 88.1. to 88.3635, which differ from the corresponding compositions 1.1 to 1.3653, more preferred 1.1 to 1.3635, only in that they comprise as the active compound A the uracilpyridine of formula (I.h.339) and additionally comprise B.30 as further herbicide B.

Also especially preferred are compositions 89.1 to 89.3653, more preferred 89.1. to 89.3635, which differ from the corresponding compositions 1.1 to 1.3653, more preferred 1.1 to 1.3635, only in that they comprise as the active compound A the uracilpyridine of formula (I.h.339) and additionally comprise B.32 as further herbicide B.

Also especially preferred are compositions 90.1 to 90.3653, more preferred 90.1. to 90.3635, which differ from the corresponding compositions 1.1 to 1.3653, more preferred 1.1 to 1.3635, only in that they comprise as the active compound A the uracilpyridine of formula (I.h.339) and additionally comprise B.35 as further herbicide B.

Also especially preferred are compositions 91.1 to 91.3653, more preferred 91.1. to 91.3635, which differ from the corresponding compositions 1.1 to 1.3653, more preferred 1.1 to 1.3635, only in that they comprise as the active compound A the uracilpyridine of formula (I.h.339) and additionally comprise B.38 as further herbicide B.

Also especially preferred are compositions 92.1 to 92.3653, more preferred 92.1. to 92.3635, which differ from the corresponding compositions 1.1 to 1.3653, more preferred 1.1 to 1.3635, only in that they comprise as the active compound A the uracilpyridine of formula (I.h.339) and additionally comprise B.40 as further herbicide B.

Also especially preferred are compositions 93.1 to 93.3653, more preferred 93.1. to 93.3635, which differ from the corresponding compositions 1.1 to 1.3653, more preferred 1.1 to 1.3635, only in that they comprise as the active compound A the uracilpyridine of formula (I.h.339) and additionally comprise B.51 as further herbicide B.

Also especially preferred are compositions 94.1 to 94.3653, more preferred 94.1. to 94.3635, which differ from the corresponding compositions 1.1 to 1.3653, more preferred 1.1 to 1.3635, only in that they comprise as the active compound A the uracilpyridine of formula (I.h.339) and additionally comprise B.55 as further herbicide B.

Also especially preferred are compositions 95.1 to 95.3653, more preferred 95.1. to 95.3635, which differ from the corresponding compositions 1.1 to 1.3653, more preferred 1.1 to 1.3635, only in that they comprise as the active compound A the uracilpyridine of formula (I.h.339) and additionally comprise B.56 as further herbicide B.

Also especially preferred are compositions 96.1 to 96.3653, more preferred 96.1. to 96.3635, which differ from the corresponding compositions 1.1 to 1.3653, more preferred 1.1 to 1.3635, only in that they comprise as the active compound A the uracilpyridine of formula (I.h.339) and additionally comprise B.64 as further herbicide B.

Also especially preferred are compositions 97.1 to 97.3653, more preferred 97.1. to 97.3635, which differ from the corresponding compositions 1.1 to 1.3653, more preferred 1.1 to 1.3635, only in that they comprise as the active compound A the uracilpyridine of formula (I.h.339) and additionally comprise B.66 as further herbicide B.

Also especially preferred are compositions 98.1 to 98.3653, more preferred 98.1. to 98.3635, which differ from the corresponding compositions 1.1 to 1.3653, more preferred 1.1 to 1.3635, only in that they comprise as the active compound A the uracilpyridine of formula (I.h.339) and additionally comprise B.67 as further herbicide B.

Also especially preferred are compositions 99.1 to 99.3653, more preferred 99.1. to 99.3635, which differ from the corresponding compositions 1.1 to 1.3653, more preferred 1.1 to 1.3635, only in that they comprise as the active compound A the uracilpyridine of formula (I.h.339) and additionally comprise B.68 as further herbicide B.

Also especially preferred are compositions 100.1 to 100.3653, more preferred 100.1. to 100.3635, which differ from the corresponding compositions 1.1 to 1.3653, more preferred 1.1 to 1.3635, only in that they comprise as the active compound A the uracilpyridine of formula (I.h.339) and additionally comprise B.69 as further herbicide B.

Also especially preferred are compositions 101.1 to 101.3653, more preferred 101.1. to 101.3635, which differ from the corresponding compositions 1.1 to 1.3653, more preferred 1.1 to 1.3635, only in that they comprise as the active compound A the uracilpyridine of formula (I.h.339) and additionally comprise B.73 as further herbicide B.

Also especially preferred are compositions 102.1 to 102.3653, more preferred 102.1. to 102.3635, which differ from the corresponding compositions 1.1 to 1.3653, more preferred 1.1 to 1.3635 only in that they comprise as the active compound A the uracilpyridine of formula (I.h.339) and additionally comprise B.76 as further herbicide B.

Also especially preferred are compositions 103.1 to 103.3653, more preferred 103.1. to 103.3635, which differ from the corresponding compositions 1.1 to 1.3653, more preferred 1.1 to 1.3635, only in that they comprise as the active compound A the uracilpyridine of formula (I.h.339) and additionally comprise B.81 as further herbicide B.

Also especially preferred are compositions 104.1 to 104.3653, more preferred 104.1. to 104.3635, which differ from the corresponding compositions 1.1 to 1.3653, more preferred 1.1 to 1.3635, only in that they comprise as the active compound A the uracilpyridine of formula (I.h.339) and additionally comprise B.82 as further herbicide B.

Also especially preferred are compositions 105.1 to 105.3653, more preferred 105.1. to 105.3635, which differ from the corresponding compositions 1.1 to 1.3653, more preferred 1.1 to 1.3635, only in that they comprise as the active compound A the uracilpyridine of formula (I.h.339) and additionally comprise B.85 as further herbicide B.

Also especially preferred are compositions 106.1 to 106.3653, more preferred 106.1. to 106.3635, which differ from the corresponding compositions 1.1 to 1.3653, more preferred 1.1 to 1.3635, only in that they comprise as the active compound A the uracilpyridine of formula (I.h.339) and additionally comprise B.88 as further herbicide B.

Also especially preferred are compositions 107.1 to 107.3653, more preferred 107.1. to 107.3635, which differ from the corresponding compositions 1.1 to 1.3653, more preferred 1.1 to 1.3635, only in that they comprise as the active compound A the uracilpyridine of formula (I.h.339) and additionally comprise B.89 as further herbicide B.

Also especially preferred are compositions 108.1 to 108.3653, more preferred 108.1. to 108.3635, which differ from the corresponding compositions 1.1 to 1.3653, more preferred 1.1 to 1.3635, only in that they comprise as the active compound A the uracilpyridine of formula (I.h.339) and additionally comprise B.94 as further herbicide B.

Also especially preferred are compositions 191.1 to 109.3653, more preferred 109.1. to 109.3635, which differ from the corresponding compositions 1.1 to 1.3653, more preferred 1.1 to 1.3635, only in that they comprise as the active compound A the uracilpyridine of formula (I.h.339) and additionally comprise B.95 as further herbicide B.

Also especially preferred are compositions 110.1 to 110.3653, more preferred 110.1. to 110.3635, which differ from the corresponding compositions 1.1 to 1.3653, more preferred 1.1 to 1.3635, only in that they comprise as the active compound A the uracilpyridine of formula (I.h.339) and additionally comprise B.98 as further herbicide B.

Also especially preferred are compositions 111.1 to 111.3653, more preferred 111.1. to 111.3635, which differ from the corresponding compositions 1.1 to 1.3653, more preferred 1.1 to 1.3635, only in that they comprise as the active compound A the uracilpyridine of formula (I.h.339) and additionally comprise B.100 as further herbicide B.

Also especially preferred are compositions 112.1 to 112.3653, more preferred 112.1. to 112.3635, which differ from the corresponding compositions 1.1 to 1.3653, more preferred 1.1 to 1.3635, only in that they comprise as the active compound A the uracilpyridine of formula (I.h.339) and additionally comprise B.103 as further herbicide B.

Also especially preferred are compositions 113.1 to 113.3653, more preferred 113.1. to 113.3635, which differ from the corresponding compositions 1.1 to 1.3653, more preferred 1.1 to 1.3635, only in that they comprise as the active compound A the uracilpyridine of formula (I.h.339) and additionally comprise B.103 and B.67 as further herbicides B.

Also especially preferred are compositions 114.1 to 114.3653, more preferred 114.1. to 114.3635, which differ from the corresponding compositions 1.1 to 1.3653, more preferred 1.1 to 1.3635, only in that they comprise as the active compound A the uracilpyridine of formula (I.h.339) and additionally comprise B.103 and B.76 as further herbicides B.

Also especially preferred are compositions 115.1 to 115.3653, more preferred 115.1. to 115.3635, which differ from the corresponding compositions 1.1 to 1.3653, more preferred 1.1 to 1.3635, only in that they comprise as the active compound A the uracilpyridine of formula (I.h.339) and additionally comprise B.103 and B.82 as further herbicides B.

Also especially preferred are compositions 116.1 to 116.3653, more preferred 116.1. to 116.3635, which differ from the corresponding compositions 1.1 to 1.3653, more preferred 1.1 to 1.3635, only in that they comprise as the active compound A the uracilpyridine of formula (I.h.339) and additionally comprise B.104 as further herbicide B.

Also especially preferred are compositions 117.1 to 117.3653, more preferred 117.1. to 117.3635, which differ from the corresponding compositions 1.1 to 1.3653, more preferred 1.1 to 1.3635, only in that they comprise as the active compound A the uracilpyridine of formula (I.h.339) and additionally comprise B.104 and B.67 as further herbicides B.

Also especially preferred are compositions 118.1 to 118.3653, more preferred 118.1. to 118.3635, which differ from the corresponding compositions 1.1 to 1.3653, more preferred 1.1 to 1.3635, only in that they comprise as the active compound A the uracilpyridine of formula (I.h.339) and additionally comprise B.104 and B.76 as further herbicides B.

Also especially preferred are compositions 119.1 to 119.3653, more preferred 119.1. to 119.3635, which differ from the corresponding compositions 1.1 to 1.3653, more preferred 1.1 to 1.3635, only in that they comprise as the active compound A the uracilpyridine of formula (I.h.339) and additionally comprise B.104 and B.82 as further herbicides B.

Also especially preferred are compositions 120.1 to 120.3653, more preferred 120.1. to 120.3635, which differ from the corresponding compositions 1.1 to 1.3653, more preferred 1.1 to 1.3635, only in that they comprise as the active compound A the uracilpyridine of formula (I.h.339) and additionally comprise B.106 as further herbicide B.

Also especially preferred are compositions 121.1 to 121.3653, more preferred 121.1. to 121.3635, which differ from the corresponding compositions 1.1 to 1.3653, more preferred 1.1 to 1.3635, only in that they comprise as the active compound A the uracilpyridine of formula (I.h.339) and additionally comprise B.107 as further herbicide B.

Also especially preferred are compositions 122.1 to 122.3653, more preferred 122.1. to 122.3635, which differ from the corresponding compositions 1.1 to 1.3653, more preferred 1.1 to 1.3635, only in that they comprise as the active compound A the uracilpyridine of formula (I.h.339) and additionally comprise B. 107 and B.67 as further herbicides B.

Also especially preferred are compositions 123.1 to 123.3653, more preferred 123.1. to 123.3635, which differ from the corresponding compositions 1.1 to 1.3653, more preferred 1.1 to 1.3635, only in that they comprise as the active compound A the uracilpyridine of formula (I.h.339) and additionally comprise B. 107 and B.76 as further herbicides B.

Also especially preferred are compositions 124.1 to 124.3653, more preferred 124.1. to 124.3635, which differ from the corresponding compositions 1.1 to 1.3653, more preferred 1.1 to 1.3635, only in that they comprise as the active compound A the uracilpyridine of formula (I.h.339) and additionally comprise B. 107 and B.82 as further herbicides B.

Also especially preferred are compositions 125.1 to 125.3653, more preferred 125.1. to 125.3635, which differ from the corresponding compositions 1.1 to 1.3653, more preferred 1.1 to 1.3635, only in that they comprise as the active compound A the uracilpyridine of formula (I.h.339) and additionally comprise B.109 as further herbicide B.

Also especially preferred are compositions 126.1 to 126.3653, more preferred 126.1. to 126.3635, which differ from the corresponding compositions 1.1 to 1.3653, more preferred 1.1 to 1.3635, only in that they comprise as the active compound A the uracilpyridine of formula (I.h.339) and additionally comprise B.111 as further herbicide B.

Also especially preferred are compositions 127.1 to 127.3653, more preferred 127.1. to 127.3635, which differ from the corresponding compositions 1.1 to 1.3653, more preferred 1.1 to 1.3635, only in that they comprise as the active compound A the uracilpyridine of formula (I.h.339) and additionally comprise B.111 and B.67 as further herbicides B.

Also especially preferred are compositions 128.1 to 128.3653, more preferred 128.1. to 128.3635, which differ from the corresponding compositions 1.1 to 1.3653, more preferred 1.1 to 1.3635, only in that they comprise as the active compound A the uracilpyridine of formula (I.h.339) and additionally comprise B.111 and B.76 as further herbicides B.

Also especially preferred are compositions 129.1 to 129.3653, more preferred 129.1. to 129.3635, which differ from the corresponding compositions 1.1 to 1.3653, more preferred 1.1 to 1.3635, only in that they comprise as the active compound A the uracilpyridine of formula (I.h.339) and additionally comprise B.111 and B.82 as further herbicides B.

Also especially preferred are compositions 130.1 to 130.3653, more preferred 130.1. to 130.3635, which differ from the corresponding compositions 1.1 to 1.3653, more preferred 1.1 to 1.3635, only in that they comprise as the active compound A the uracilpyridine of formula (I.h.339) and additionally comprise B. 116 as further herbicide B.

Also especially preferred are compositions 131.1 to 131.3653, more preferred 131.1. to 131.3635, which differ from the corresponding compositions 1.1 to 1.3653, more preferred 1.1 to 1.3635, only in that they comprise as the active compound A the uracilpyridine of formula (I.h.339) and additionally comprise B.116 and B.67 as further herbicides B.

Also especially preferred are compositions 132.1 to 132.3653, more preferred 132.1. to 132.3635, which differ from the corresponding compositions 1.1 to 1.3653, more preferred 1.1 to 1.3635, only in that they comprise as the active compound A the uracilpyridine of formula (I.h.339) and additionally comprise B.116 and B.94 as further herbicides B.

Also especially preferred are compositions 133.1 to 133.3653, more preferred 133.1. to 133.3635, which differ from the corresponding compositions 1.1 to 1.3653, more preferred 1.1 to 1.3635, only in that they comprise as the active compound A the uracilpyridine of formula (I.h.339) and additionally comprise B.116 and B.103 as further herbicides B.

Also especially preferred are compositions 134.1 to 134.3653, more preferred 134.1. to 134.3635, which differ from the corresponding compositions 1.1 to 1.3653, more preferred 1.1 to 1.3635, only in that they comprise as the active compound A the uracilpyridine of formula (I.h.339) and additionally comprise B.116 and B.128 as further herbicides B.

Also especially preferred are compositions 135.1 to 135.3653, more preferred 135.1. to 135.3635, which differ from the corresponding compositions 1.1 to 1.3653, more preferred 1.1 to 1.3635, only in that they comprise as the active compound A the uracilpyridine of formula (I.h.339) and additionally comprise B.116 and B.104 as further herbicides B.

Also especially preferred are compositions 136.1 to 136.3653, more preferred 136.1. to 136.3635, which differ from the corresponding compositions 1.1 to 1.3653, more preferred 1.1 to 1.3635, only in that they comprise as the active compound A the uracilpyridine of formula (I.h.339) and additionally comprise B.116 and B.107 as further herbicides B.

Also especially preferred are compositions 137.1 to 137.3653, more preferred 137.1. to 137.3635, which differ from the corresponding compositions 1.1 to 1.3653, more preferred 1.1 to 1.3635, only in that they comprise as the active compound A the uracilpyridine of formula (I.h.339) and additionally comprise B.116 and B.111 as further herbicides B.

Also especially preferred are compositions 138.1 to 138.3653, more preferred 138.1. to 138.3635, which differ from the corresponding compositions 1.1 to 1.3653, more preferred 1.1 to 1.3635, only in that they comprise as the active compound A the uracilpyridine of formula (I.h.339) and additionally comprise B.122 as further herbicide B.

Also especially preferred are compositions 139.1 to 139.3653, more preferred 139.1. to 139.3635, which differ from the corresponding compositions 1.1 to 1.3653, more preferred 1.1 to 1.3635, only in that they comprise as the active compound A the uracilpyridine of formula (I.h.339) and additionally comprise B.126 as further herbicide B.

Also especially preferred are compositions 140.1 to 140.3653, more preferred 140.1. to 140.3635, which differ from the corresponding compositions 1.1 to 1.3653, more preferred 1.1 to 1.3635, only in that they comprise as the active compound A the uracilpyridine of formula (I.h.339) and additionally comprise B.128 as further herbicide B.

Also especially preferred are compositions 141.1 to 141.3653, more preferred 141.1. to 141.3635, which differ from the corresponding compositions 1.1 to 1.3653, more preferred 1.1 to 1.3635, only in that they comprise as the active compound A the uracilpyridine of formula (I.h.339) and additionally comprise B.131 as further herbicide B.

Also especially preferred are compositions 142.1 to 142.3653, more preferred 142.1. to 142.3635, which differ from the corresponding compositions 1.1 to 1.3653, more preferred 1.1 to 1.3635, only in that they comprise as the active compound A the uracilpyridine of formula (I.h.339) and additionally comprise B.132 as further herbicide B.

Also especially preferred are compositions 143.1 to 143.3653, more preferred 143.1. to 143.3635, which differ from the corresponding compositions 1.1 to 1.3653, more preferred 1.1 to 1.3635, only in that they comprise as the active compound A the uracilpyridine of formula (I.h.339) and additionally comprise B.133 as further herbicide B.

Also especially preferred are compositions 144.1 to 144.3653, more preferred 144.1. to 144.3635, which differ from the corresponding compositions 1.1 to 1.3653, more preferred 1.1 to 1.3635, only in that they comprise as the active compound A the uracilpyridine of formula (I.h.339) and additionally comprise B.135 as further herbicide B.

Also especially preferred are compositions 145.1 to 145.3653, more preferred 145.1. to 145.3635, which differ from the corresponding compositions 1.1 to 1.3653, more preferred 1.1 to 1.3635, only in that they comprise as the active compound A the uracilpyridine of formula (I.h.339) and additionally comprise B.137 as further herbicide B.

Also especially preferred are compositions 146.1 to 146.3653, more preferred 146.1. to 146.3635, which differ from the corresponding compositions 1.1 to 1.3653, more preferred 1.1 to 1.3635, only in that they comprise as the active compound A the uracilpyridine of formula (I.h.339) and additionally comprise B.138 as further herbicide B.

Also especially preferred are compositions 147.1 to 147.3653, more preferred 147.1. to 147.3635, which differ from the corresponding compositions 1.1 to 1.3653, more preferred 1.1 to 1.3635, only in that they comprise as the active compound A the uracilpyridine of formula (I.h.339) and additionally comprise B.140 as further herbicide B.

Also especially preferred are compositions 148.1 to 148.3653, more preferred 148.1. to 148.3635, which differ from the corresponding compositions 1.1 to 1.3653, more preferred 1.1 to 1.3635, only in that they comprise as the active compound A the uracilpyridine of formula (I.h.339) and additionally comprise B.145 as further herbicide B.

Also especially preferred are compositions 149.1 to 149.3653, more preferred 149.1. to 149.3635, which differ from the corresponding compositions 1.1 to 1.3653, more preferred 1.1 to 1.3635, only in that they comprise as the active compound A the uracilpyridine of formula (I.h.339) and additionally comprise B.153 as further herbicide B.

Also especially preferred are compositions 150.1 to 150.3653, more preferred 150.1. to 150.3635, which differ from the corresponding compositions 1.1 to 1.3653, more preferred 1.1 to 1.3635, only in that they comprise as the active compound A the uracilpyridine of formula (I.h.339) and additionally comprise B.156 as further herbicide B.

Also especially preferred are compositions 151.1 to 151.3653, more preferred 151.1. to 151.3635, which differ from the corresponding compositions 1.1 to 1.3653, more preferred 1.1 to 1.3635, only in that they comprise as the active compound A the uracilpyridine of formula (I.h.339) and additionally comprise B.171 as further herbicide B.

Also especially preferred are compositions 152.1 to 152.3653, more preferred 152.1. to 152.3635, which differ from the corresponding compositions 1.1 to 1.3653, more preferred 1.1 to 1.3635, only in that they comprise as the active compound A the uracilpyridine of formula (I.h.339) and additionally comprise B.174 as further herbicide B.

It is generally preferred to use the compounds of the invention in combination with herbicides that are selective for the crop being treated and which complement the spectrum of weeds controlled by these compounds at the application rate employed. It is further generally preferred to apply the compounds of the invention and other complementary herbicides at the same time, either as a combination formulation or as a tank mix.

It is recognized that the polynucleotide molecules and polypeptides of the invention encompass polypeptides comprising an amino acid sequence that is sufficiently identical to the amino acid sequences set forth in SEQ ID Nos: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 577, 579, 581, 583, 585, 587, 589, 591, 593, 595, 597, 599, 601, 603, 605, 607, 609, 611, 613, 615, 617, 619, 621, 623, 625, 627, or 637. The term "sufficiently identical" is used herein to refer to a first amino acid or nucleotide sequence that contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity.

Generally, "sequence identity" refers to the extent to which two optimally aligned DNA or amino acid sequences are invariant throughout a window of alignment of components, e.g., nucleotides or amino acids. An "identity fraction" for aligned segments of a test sequence and a reference sequence is the number of identical components that are shared by the two aligned sequences divided by the total number of components in reference sequence segment, i.e., the entire reference sequence or a smaller defined part of the reference sequence. "Percent identity" is the identity fraction times 100. Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and preferably by computerized implementations of these algorithms such as GAP, BESTFIT, FASTA, and TFASTA available as part of the GCG. Wisconsin Package. (Accelrys Inc. Burlington, Mass.)

Polynucleotides and Oligonucleotides

By an "isolated polynucleotide", including DNA, RNA, or a combination of these, single or double stranded, in the sense or antisense orientation or a combination of both, dsRNA or otherwise, we mean a polynucleotide which is at least partially separated from the polynucleotide sequences with which it is associated or linked in its native state. That means other nucleic acid molecules are present in an amount less than 5% based on weight of the amount of the desired nucleic acid, preferably less than 2% by weight, more preferably less than 1% by weight, most preferably less than 0.5% by weight. Preferably, an "isolated" nucleic acid is free of some of the sequences that naturally flank the nucleic acid (i.e., sequences located at the 5' and 3' ends of the nucleic acid) in the genomic DNA of the organism from which the nucleic acid is derived. For example, in various embodiments, the isolated herbicide resistance and/or tolerance related protein encoding nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized. Preferably, the isolated polynucleotide is at least 60% free, preferably at least 75% free, and most preferably at least 90% free from other components with which they are naturally associated. As the skilled addressee would be aware, an isolated polynucleotide can be an exogenous polynucleotide present in, for example, a transgenic organism which does not naturally comprise the polynucleotide. Furthermore, the terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

The term "mutated PPO nucleic acid" refers to a PPO nucleic acid having a sequence that is mutated from a wild-type PPO nucleic acid, such as e.g. SEQ ID NO: 118, 119, 120, 121, 122, 123, 124, 125, 126, 127, 128, 624, 626, or 650, or homologues, paralogues and orthologues thereof; and that confers increased uracilpyridine herbicide tolerance to a plant in which it is expressed. Furthermore, the term "mutated protoporphyrinogen oxidase (mutated PPO)" refers to the replacement of an amino acid of the wild-type primary sequences SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, or a variant, a derivative, a homologue, an orthologue, or paralogue thereof, with another amino acid. The expression "mutated amino acid" will be used below to designate the amino acid which is replaced by another amino acid, thereby designating the site of the mutation in the primary sequence of the protein.

In a preferred embodiment, the PPO nucleotide sequence encoding a mutated PPO comprises the sequence of SEQ ID NO: 118, 119, 120, 121, 122, 123, 124, 125, 126, 127, 128, 624, 626, or 650, or a variant or derivative thereof.

Furthermore, it will be understood by the person skilled in the art that the PPO nucleotide sequences encompasse homologues, paralogues and orthologues of SEQ ID NO: 118, 119, 120, 121, 122, 123, 124, 125, 126, 127, 128, 624, 626, or 650, as defined hereinafter.

The term "variant" with respect to a sequence (e.g., a polypeptide or nucleic acid sequence such as—for example—a transcription regulating nucleotide sequence of the invention) is intended to mean substantially similar sequences. For nucleotide sequences comprising an open reading frame, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis and for open reading frames, encode the native protein, as well as those that encode a polypeptide having amino acid substitutions relative to the native protein, e.g. the mutated PPO according to the present invention as disclosed herein.

Generally, nucleotide sequence variants of the invention will have at least 30, 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide "sequence identity" to the nucleotide sequence encoding a polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, 637, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, or 565.

The % identity of a polynucleotide is determined by GAP (Needleman and Wunsch, 1970) analysis (GCG program) with a gap creation penalty=5, and a gap extension penalty=0.3. Unless stated otherwise, the query sequence is at least 45 nucleotides in length, and the GAP analysis aligns the two sequences over a region of at least 45 nucleotides. Preferably, the query sequence is at least 150 nucleotides in length, and the GAP analysis aligns the two sequences over a region of at least 150 nucleotides. More preferably, the query sequence is at least 300 nucleotides in length and the GAP analysis aligns the two sequences over a region of at least 300 nucleotides. Even more preferably, the GAP analysis aligns the two sequences over their entire length.

Polypeptides

By "substantially purified polypeptide" or "purified" a polypeptide is meant that has been separated from one or more lipids, nucleic acids, other polypeptides, or other contaminating molecules with which it is associated in its native state. It is preferred that the substantially purified polypeptide is at least 60% free, more preferably at least 75% free, and more preferably at least 90% free from other components with which it is naturally associated. As the skilled addressee will appreciate, the purified polypeptide can be a recombinantly produced polypeptide. The terms "polypeptide" and "protein" are generally used interchangeably and refer to a single polypeptide chain which may or may not be modified by addition of non-amino acid groups. It would be understood that such polypeptide chains may associate with other polypeptides or proteins or other molecules such as co-factors. The terms "proteins" and "polypeptides" as used herein also include variants, mutants, modifications, analogous and/or derivatives of the polypeptides of the invention as described herein.

The % identity of a polypeptide is determined by GAP (Needleman and Wunsch, 1970) analysis (GCG program) with a gap creation penalty=5, and a gap extension penalty=0.3. The query sequence is at least 25 amino acids in length, and the GAP analysis aligns the two sequences over a region of at least 25 amino acids. More preferably, the query sequence is at least 50 amino acids in length, and the GAP analysis aligns the two sequences over a region of at least 50 amino acids. More preferably, the query sequence is at least 100 amino acids in length and the GAP analysis aligns the two sequences over a region of at least 100 amino acids. Even more preferably, the query sequence is at least 250 amino acids in length and the GAP analysis aligns the two sequences over a region of at least 250 amino acids. Even more preferably, the GAP analysis aligns the two sequences over their entire length.

With regard to a defined polypeptide, it will be appreciated that % identity figures higher than those provided above will encompass preferred embodiments. Thus, where applicable, in light of the minimum % identity figures, it is preferred that the PPO polypeptide of the invention comprises an amino acid sequence which is at least 40%, more preferably at least 45%, more preferably at least 50%, more preferably at least 55%, more preferably at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, 637, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564,or 565.

By "variant" polypeptide is intended a polypeptide derived from the protein of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, 637, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, or 565, by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Such variants may result from, for example, genetic polymorphism or from human manipulation. Methods for such manipulations are generally known in the art.

"Derivatives" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break a-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds).

TABLE 1

Examples of conserved amino acid substitutions

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

"Derivatives" further include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

"Orthologues" and "paralogues" encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

It is well-known in the art that paralogues and orthologues may share distinct domains harboring suitable amino acid residues at given sites, such as binding pockets for particular substrates or binding motifs for interaction with other proteins.

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain). Preferred motifs which are contained in the sequences of the PPO polypeptides according to the present invention are SQ[N/K/H]KRYI, TLGTLFSS, [F/Y]TTF[V/I]GG.

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788(2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI).

Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

The inventors of the present invention have found that by substituting one or more of the key amino acid residues, employing e.g. one of the above described methods to mutate the encoding nucleic acids, the uracilpyridine herbicide tolerance or resistance could be remarkably increased as compared to the activity of the wild type PPO enzymes with SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637. Preferred substitutions of mutated PPO are those that increase the herbicide tolerance of the plant, but leave the biological activity of the oxidase activity substantially unaffected.

Accordingly, in another object of the present invention the key amino acid residues of a PPO enzyme comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, is substituted by any other amino acid.

In one embodiment, the key amino acid residues of a PPO enzyme, a variant, derivative, orthologue, paralogue or homologue thereof, is substituted by a conserved amino acid as depicted in Table 1.

It will be understood by the person skilled in the art that amino acids located in a close proximity to the positions of amino acids mentioned below may also be substituted. Thus, in another embodiment the variant of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof comprises a mutated PPO, wherein an amino acid 3, ±2 or ±1 amino acid positions from a key amino acid is substituted by any other amino acid.

Based on techniques well-known in the art, a highly characteristic sequence pattern can be developed, by means of which further of mutated PPO candidates with the desired activity may be searched.

Searching for further mutated PPO candidates by applying a suitable sequence pattern would also be encompassed by the present invention. It will be understood by a skilled reader that the present sequence pattern is not limited by the exact distances between two adjacent amino acid residues of said pattern. Each of the distances between two neighbours in the above patterns may, for example, vary independently of each other by up to ±10, ±5, ±3, ±2 or ±1 amino acid positions without substantially affecting the desired activity.

Furthermore, by applying the method of site directed mutagenesis, in particular saturation mutagenes (see e.g. Schenk et al., Biospektrum 03/2006, pages 277-279), the inventors of the present invention have identified and generated specific amino acid substitutions and combinations thereof, which—when introduced into a plant by transforming and expressing the respective mutated PPO encoding nucleic acid—confer increased herbicide resistance or tolerance to a uracilpyridine herbicide to said plant.

Thus, in a particularly preferred embodiment, the variant or derivative of the mutated PPO refers to a polypeptide comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, or 637, comprising a single amino acid substitution at positions depicted in the following Table 2a.

TABLE 2a-1

Single amino acid substitutions within SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, or 637

| SEQ ID | Organism | Mutated site 1 | Mutated site 2 | Mutated site 3 | Mutated site 4 | Mutated site 5 |
|---|---|---|---|---|---|---|
| 1 | Amaranthus tuberculatus | R128 | G210 | G211 | L397 | F420 |
| 2 | Amaranthus tuberculatus | R128 | G210 | G211 | L397 | F420 |
| 3 | Amaranthus tuberculatus | R128 | G210 | — | L396 | F419 |
| 4 | Amaranthus tuberculatus | R128 | G210 | — | L396 | F419 |
| 5 | Amaranthus hypochondriacus | R128 | G210 | G211 | L398 | F421 |
| 6 | Amaranthus tuberculatus | R98 | G180 | G181 | L368 | F391 |
| 7 | Spinacia oleracea | R127 | G209 | G210 | L397 | F420 |
| 8 | Vitis vinifera | R100 | G182 | G183 | L373 | F396 |
| 9 | Ricinus communis | R99 | A181 | G182 | L372 | F395 |
| 10 | Theobroma cacao | R98 | A180 | G181 | L370 | F393 |
| 11 | Glycine max | R98 | A180 | A181 | L367 | F390 |
| 12 | Prunus persica | R96 | A175 | G176 | L366 | F389 |
| 13 | Medicago truncatula | R98 | A180 | A181 | L367 | F390 |
| 14 | Fragaria vesca subsp. vesca | R98 | A177 | G178 | L368 | F391 |
| 15 | Citrus clementina | R98 | A180 | A181 | L370 | F393 |
| 16 | Citrus clementina | R98 | A180 | A181 | L370 | F393 |
| 17 | Cicer arietinum | R98 | A180 | A181 | L367 | F390 |
| 18 | Cucumis sativus | R98 | A180 | G181 | L368 | F391 |
| 19 | Cucumis sativus | R93 | A175 | G176 | L363 | F386 |
| 20 | Nicotiana tabacum | R98 | G178 | G179 | L369 | F392 |
| 21 | Solanum lycopersicum | R95 | G175 | G176 | L366 | F389 |
| 22 | Arabidopsis thaliana | R101 | A182 | A183 | L371 | F394 |
| 23 | Arabidopsis lyrata subsp. lyrata | R103 | A186 | A187 | L375 | F398 |
| 24 | Arabidopsis thaliana | R101 | A182 | A183 | L364 | F387 |
| 25 | Arabidopsis thaliana | R147 | A228 | A229 | L410 | F433 |
| 26 | Ambrosia artemisiifolia | R74 | G151 | G152 | L336 | F359 |
| 27 | Setaria italica | R128 | A213 | G214 | L408 | F431 |
| 28 | Sorghum bicolor | R130 | A215 | G216 | L410 | F433 |
| 29 | Arabidopsis thaliana | R101 | A152 | A153 | L341 | F364 |
| 30 | Zea mays | R130 | A215 | G216 | L410 | F433 |
| 31 | Zea mays | R130 | A215 | G216 | L410 | F433 |
| 32 | LEMPA | R105 | G188 | G189 | L381 | F404 |
| 33 | LEMPA | R150 | A226 | G227 | L409 | Y432 |
| 34 | Populus trichocarpa | R100 | A182 | G183 | L373 | F396 |
| 35 | Capsella rubella | R165 | A248 | A249 | L433 | F456 |
| 36 | Brachypodium distachyon | R134 | A219 | G220 | L414 | F437 |
| 37 | Oryza sativa Japonica Group | R95 | G179 | G180 | L374 | F397 |
| 38 | Picea sitchensis | R100 | G186 | A187 | L354 | F377 |
| 39 | Solanum tuberosum | R98 | G178 | G179 | L369 | F392 |
| 40 | Oryza sativa Indica Group | R139 | G224 | G225 | L419 | F442 |
| 41 | Oryza sativa Japonica Group | R139 | G224 | G225 | L419 | F442 |
| 42 | Eutrema salsugineum | R96 | A179 | A180 | L368 | F391 |
| 43 | Selaginella moellendorffii | R97 | G175 | S176 | L377 | F400 |
| 44 | Selaginella moellendorffii | R97 | G175 | S176 | L377 | F400 |
| 45 | Amaranthus tuberculatus | R128 | G210 | G211 | — | — |
| 46 | Amaranthus tuberculatus | R128 | G210 | — | — | — |
| 47 | Zea mays | — | A67 | G68 | L262 | F285 |
| 48 | Aegilops tauschii | R30 | A96 | G97 | L291 | F314 |
| 49 | Genlisea aurea | R89 | G168 | G169 | — | — |
| 50 | Amborella trichopoda | — | — | — | L161 | F184 |
| 51 | Rhodothermus marinus | R87 | A162 | G163 | L330 | F353 |
| 52 | Salinibacter ruber | R87 | A161 | G162 | L330 | F353 |
| 53 | Salinibacter ruber M8 | R87 | A161 | G162 | L330 | F353 |
| 54 | Zea mays | — | — | — | L69 | F92 |
| 55 | Rhodothermus marinus | R87 | A162 | G163 | L330 | F353 |
| 56 | Caldithrix abyssi | R86 | A160 | G161 | L329 | F352 |

TABLE 2a-1-continued

Single amino acid substitutions within SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, or 637

| SEQ ID | Organism | Mutated site 1 | Mutated site 2 | Mutated site 3 | Mutated site 4 | Mutated site 5 |
|---|---|---|---|---|---|---|
| 57 | Opitutus terrae PB90-1 | R103 | A178 | G179 | L345 | M368 |
| 58 | Verrucomicrobia bacterium | R91 | A166 | G167 | L332 | Y355 |
| 59 | Ignavibacterium album | R88 | A163 | G164 | L332 | F355 |
| 60 | Coraliomargarita sp. CAG:312 | R88 | G163 | A164 | L331 | Y354 |
| 61 | Salisaeta longa | R88 | A163 | G164 | L329 | F352 |
| 62 | Ambrosia artemisiifolia | R98 | G175 | G176 | — | — |
| 63 | Melioribacter roseus P3M-2 | R88 | A163 | G164 | L333 | F356 |
| 64 | Halothiobacillus neapolitanus c2 | R97 | A170 | G171 | L343 | F366 |
| 65 | Chondrus crispus | Y98 | S176 | G177 | L352 | Y376 |
| 66 | Rubritalea marina | R88 | A163 | G164 | L339 | M362 |
| 67 | Acidobacteria bacterium | R88 | A161 | G162 | L330 | F353 |
| 68 | Coraliomargarita akajimensis DSM 45221 | R88 | A163 | G164 | L323 | F346 |
| 69 | Oscillochloris trichoides DG6 | R90 | S164 | G165 | L340 | L363 |
| 70 | Opitutaceae bacterium TAV1 | R86 | A161 | G162 | L352 | L375 |
| 71 | Amborella trichopoda | R87 | A173 | A174 | L230 | — |
| 72 | Opitutaceae bacterium TAV5 | R105 | A180 | G181 | L368 | L391 |
| 73 | Chloroflexus sp. Y-400-fl | R91 | A166 | G167 | L335 | L358 |
| 74 | Leptospirillum sp. Group II '5-way CG' | R92 | A167 | S168 | L335 | F358 |
| 75 | Leptospirillum ferriphilum ML-04 | R92 | A167 | S168 | L335 | F358 |
| 76 | Verrucomicrobia bacterium SCGC AAA300-O17 | R89 | A165 | A166 | L334 | Y357 |
| 77 | Chloroflexus aggregans DSM 9485 | R92 | A167 | G168 | L336 | L359 |
| 78 | Desulfurobacterium thermolithotrophum | R86 | A161 | G162 | L333 | M356 |
| 79 | Desulfurobacterium sp. TCS-1 | R90 | A165 | G166 | L332 | M355 |
| 80 | Arthrospira platensis C1 | R93 | A176 | G177 | L352 | Y375 |
| 81 | Leptospirillum sp. Group II 'C75' | R92 | A167 | S168 | L335 | F358 |
| 82 | Verrucomicrobiae bacterium DG1235 | R87 | A164 | G165 | L332 | M355 |
| 83 | Verrucomicrobia bacterium SCGC AAA300-K03 | R89 | A165 | A166 | L334 | F357 |
| 84 | Synechococcus sp. JA-3-3Ab | R101 | A177 | G178 | L350 | F373 |
| 85 | Hymenobacter norwichensis | R86 | A161 | G162 | A321 | F344 |
| 86 | Pontibacter sp. BAB1700 | R85 | G159 | G160 | S319 | Y342 |
| 87 | Leptospirillum ferrodiazotrophum | R92 | A172 | S173 | L339 | F362 |
| 88 | Prevotella histicola F0411 | C89 | A164 | G165 | L328 | F351 |
| 89 | Flexithrix dorotheae | R84 | A158 | G159 | A313 | F336 |
| 90 | Geobacter metallireducens GS-15 | R93 | A168 | G169 | L342 | M365 |
| 91 | Synechococcus sp. JA-2-3B'a(2-13) | R93 | A169 | G170 | L362 | F385 |
| 92 | Crinalium epipsammum PCC 9333 | R85 | A168 | G169 | L344 | F367 |
| 93 | Planctomyces mans | A99 | T187 | S188 | F358 | F381 |
| 94 | Geobacter uraniireducens Rf4 | R93 | A170 | G171 | L344 | M367 |
| 95 | Acidithiobacillus ferrivorans | R87 | A162 | G163 | L323 | F346 |
| 96 | Prevotella melaninogenica | C88 | A163 | G164 | L327 | F350 |
| 97 | Thermovibrio ammonificans | R86 | A160 | G161 | L333 | M356 |
| 98 | Brassica_rapa | R143 | A219 | G220 | L402 | Y425 |
| 99 | Brassica_rapa | R112 | A195 | A196 | L384 | F407 |
| 100 | Gossypium | R146 | A222 | G223 | L405 | Y428 |
| 101 | Gossypium | R98 | A180 | G181 | L370 | F393 |

TABLE 2a-1-continued

Single amino acid substitutions within SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, or 637

| SEQ ID | Organism | Mutated site 1 | Mutated site 2 | Mutated site 3 | Mutated site 4 | Mutated site 5 |
|---|---|---|---|---|---|---|
| 102 | Conyza_canadensis | R142 | A218 | G219 | L401 | Y424 |
| 103 | Conyza_canadensis | R102 | G179 | G180 | L365 | F388 |
| 104 | Kochia_scobaria | R172 | A248 | G249 | L431 | F454 |
| 105 | Lolium_rigidum | R138 | A214 | G215 | L397 | Y420 |
| 106 | Lolium_rigidum | R97 | A182 | G183 | L377 | F400 |
| 107 | Gossypium hirsutum PPO1 | R146 | A222 | G223 | L405 | Y428 |
| 108 | Beta vulgaris PPO1 | R167 | A243 | G244 | L426 | Y449 |
| 109 | Hordeum vulgare PPO1 | R137 | A213 | G214 | L396 | Y419 |
| 110 | Hordeum vulgare PPO2 | R142 | A227 | G228 | L422 | F445 |
| 111 | Triticum aestivum PPO1 | R138 | A214 | G215 | L397 | Y420 |
| 112 | Solanum lycopersicum PPO2 | R95 | G175 | G176 | L366 | F389 |
| 113 | Triticum aestivum PPO1_v2 | R153 | A229 | G230 | L412 | Y435 |
| 114 | Gossypium hirsutum PPO1_v2 | R146 | A222 | G223 | L405 | Y428 |
| 115 | Gossypium hirsutum PPO2 | R98 | A180 | G181 | L370 | F393 |
| 116 | Beta vulgaris PPO1_v2 | R167 | A243 | G244 | L426 | Y449 |
| 117 | Brassica napus_PPO2 | R99 | A182 | A183 | L371 | F394 |
| 637 | Oryza sativa_PPO2 | R139 |  | G225 | L419 | F442 |

TABLE 2a-2

Additional single amino acid substitutions within reference to SEQ ID NO: 1, or 637

| SEQ ID | Organism | Mutated site 6 | Mutated site 7 |
|---|---|---|---|
| 1 | Amaranthus tuberculatus | G398 | L400 |
| 637 | Oryza sativa_PPO2 | G420 | L422 |

In a further particularly preferred embodiment, the variant or derivative of the mutated PPO refers to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, or 637, comprising a single amino acid substitutions at the positions depicted in the following Table 2b.

It should be noted that Mutated site 1 of Table 2a) corresponds to Pos 1 of Table 2b); Mutated site 2 of Table 2a) corresponds to Pos 16 of Table 2b); Mutated site 3 of Table 2a) corresponds to Pos 17 of Table 2b); Mutated site 4 of Table 2a) corresponds to Pos 38 of Table 2b); Mutated site 5 of Table 2a) corresponds to Pos 42 of Table 2b).

TABLE 2b

| ID | Pos 1 | Pos 2 | Pos 3 | Pos 4 | Pos 5 | Pos 6 | Pos 7 | Pos 8 | Pos 9 | Pos 10 | Pos 11 | Pos 12 | Pos 13 | Pos 14 | Pos 15 | Pos 16 | Pos 17 | Pos 18 | Pos 19 |
|---|---|---|---|---|---|---|---|---|---|---|---|---|---|---|---|---|---|---|---|
| 1 | R128 | Y129 | A131 | S149 | I151 | A154 | P164 | K169 | E182 | S183 | E189 | F196 | D202 | C209 | G210 | G211 | L216 | M218 | H219 |
| 2 | R128 | Y129 | A131 | S149 | I151 | A154 | P164 | K169 | E182 | S183 | E189 | F196 | D202 | C209 | G210 | G211 | L216 | M218 | H219 |
| 3 | R128 | Y129 | A131 | S149 | I151 | A154 | P164 | K169 | E182 | S183 | E189 | F196 | D202 | C209 | G210 | — | L215 | M217 | H218 |
| 4 | R128 | Y129 | A131 | S149 | I151 | A154 | P164 | K169 | E182 | S183 | E189 | F196 | D202 | C209 | G210 | — | L215 | M217 | Y218 |
| 5 | R128 | Y129 | A131 | S149 | I151 | A154 | P164 | K169 | E182 | S183 | E189 | F196 | D202 | C209 | G210 | G211 | L216 | V218 | H219 |
| 6 | R98 | Y99 | A101 | S119 | I121 | A124 | P134 | K139 | E152 | S153 | E159 | F166 | D172 | C179 | G180 | G181 | L186 | M188 | H189 |
| 7 | R127 | Y128 | A130 | S148 | I150 | A153 | P163 | K168 | E181 | S182 | E188 | F195 | D201 | S208 | G209 | G210 | L215 | M217 | R218 |
| 8 | R100 | Y101 | V103 | S121 | I123 | A126 | P136 | K141 | E154 | S155 | Q161 | V168 | D174 | S181 | G182 | G183 | L188 | M190 | H191 |
| 9 | R99 | Y100 | V102 | S120 | I122 | A125 | P135 | K140 | E153 | S154 | Q160 | V167 | D173 | S180 | A181 | G182 | L187 | V189 | C190 |
| 10 | R98 | Y99 | V101 | S119 | I121 | A124 | P134 | K139 | E152 | S153 | Q159 | V166 | D172 | S179 | A180 | G181 | L186 | M188 | R189 |
| 11 | R98 | Y99 | V101 | S119 | L121 | A124 | P134 | R139 | E152 | S153 | E159 | V166 | D172 | S179 | A180 | A181 | L186 | M188 | R189 |
| 12 | R96 | Y97 | V99 | S117 | F119 | A122 | P132 | D137 | E147 | S148 | Q154 | V161 | D167 | S174 | A175 | G176 | L181 | M183 | R184 |
| 13 | R98 | Y99 | V101 | S119 | L121 | A124 | P134 | R139 | E152 | S153 | E159 | V166 | D172 | S179 | A180 | A181 | L186 | I188 | R189 |
| 14 | R98 | Y99 | A101 | S119 | F121 | T124 | P134 | K139 | E149 | S150 | Q156 | V163 | D169 | S176 | A177 | G178 | L183 | M185 | P186 |
| 15 | R98 | Y99 | V101 | S119 | F121 | A124 | P134 | K139 | E152 | S153 | Q159 | V166 | D172 | S179 | A180 | A181 | L186 | M188 | R189 |
| 16 | R98 | Y99 | V101 | S119 | F121 | A124 | P134 | K139 | E152 | S153 | Q159 | V166 | D172 | S179 | A180 | A181 | L186 | M188 | R189 |
| 17 | R98 | Y99 | V101 | S119 | L121 | A124 | P134 | R139 | E152 | S153 | E159 | V166 | D172 | S179 | A180 | A181 | L186 | M188 | R189 |
| 18 | R98 | Y99 | V101 | S119 | F121 | A124 | P134 | K139 | E152 | S153 | Q159 | V166 | D172 | S179 | A180 | G181 | L186 | M188 | S189 |
| 19 | R93 | Y94 | V96 | S114 | F116 | A119 | P129 | K134 | E147 | S148 | Q154 | V161 | D167 | S174 | A175 | G176 | L181 | M183 | S184 |
| 20 | R98 | Y99 | A101 | S119 | F121 | T124 | P134 | N139 | E150 | S151 | Q157 | V164 | D170 | C177 | G178 | G179 | L184 | M186 | H187 |
| 21 | R95 | Y96 | A98 | S116 | F118 | T121 | P131 | N136 | E147 | S148 | Q154 | V161 | D167 | C174 | G175 | G176 | L181 | M183 | H184 |
| 22 | R101 | Y102 | V104 | S122 | V124 | T127 | P137 | K142 | E154 | S155 | Q161 | V168 | D174 | S181 | A182 | A183 | L188 | M190 | K191 |
| 23 | R103 | Y104 | V106 | S124 | V126 | T129 | P139 | K144 | E158 | S159 | Q165 | V172 | D178 | S185 | A186 | A187 | L192 | M194 | K195 |
| 24 | R101 | Y102 | V104 | S122 | V124 | T127 | P137 | K142 | E154 | S155 | Q161 | V168 | D174 | S181 | A182 | A183 | L188 | M190 | K191 |
| 25 | R147 | Y148 | V150 | S168 | V170 | T173 | P183 | K188 | E200 | S201 | Q207 | V214 | D220 | S227 | A228 | A229 | L234 | M236 | K237 |
| 26 | R74 | Y75 | V77 | S95 | F97 | T100 | P110 | K115 | E123 | S124 | Q130 | V137 | D143 | S150 | G151 | G152 | L157 | M159 | R160 |

TABLE 2b-continued

| | | | | | | | | | | | | | | | | | | |
|---|---|---|---|---|---|---|---|---|---|---|---|---|---|---|---|---|---|---|
| 27 | R128 | Y129 | V131 | S149 | V151 | T154 | P164 | K169 | E185 | S186 | E192 | V199 | D205 | S212 | A213 | G214 | L219 | I221 | R222 |
| 28 | R130 | Y131 | V133 | S151 | V153 | T156 | P166 | K171 | E187 | S188 | E194 | V201 | D207 | S214 | A215 | G216 | L221 | I223 | C224 |
| 29 | R101 | Y102 | V104 | — | — | — | — | — | E124 | S125 | Q131 | V138 | D144 | S151 | A152 | A153 | L158 | M160 | K161 |
| 30 | R130 | Y131 | V133 | S151 | V153 | T156 | P166 | K171 | E187 | S188 | E194 | V201 | D207 | S214 | A215 | G216 | L221 | I223 | R224 |
| 31 | R130 | Y131 | V133 | S151 | V153 | T156 | P166 | K171 | E187 | S188 | E194 | V201 | D207 | S214 | A215 | G216 | L221 | I223 | R224 |
| 32 | R105 | Y106 | V108 | S126 | L128 | T131 | P141 | R146 | E160 | S161 | Q167 | V174 | D180 | S187 | G188 | G189 | L194 | M196 | P197 |
| 33 | R150 | F151 | L153 | F171 | L173 | I176 | A186 | P191 | E201 | E202 | — | V212 | E218 | Y225 | A226 | G227 | L232 | M234 | K235 |
| 34 | R100 | Y101 | V103 | S121 | F123 | A126 | P136 | K141 | A154 | S155 | Q161 | V168 | D174 | S181 | A182 | G183 | L188 | A190 | R191 |
| 35 | R165 | Y166 | V168 | S186 | V188 | T191 | P201 | K206 | E220 | S221 | R227 | V234 | D240 | S247 | A248 | A249 | L254 | M277 | K278 |
| 36 | R134 | Y135 | V137 | S155 | V157 | T160 | P170 | K175 | E191 | S192 | E198 | V205 | D211 | S218 | A219 | G220 | L225 | I227 | R228 |
| 37 | R95 | Y96 | V98 | S116 | V118 | T121 | P131 | K136 | E152 | S153 | C158 | V165 | D171 | S178 | G179 | G180 | L185 | I187 | R188 |
| 38 | R100 | Y101 | V103 | S121 | T123 | A126 | P136 | K141 | E158 | S159 | R165 | V172 | D178 | A185 | G186 | A187 | L192 | I194 | R195 |
| 39 | R98 | Y99 | A101 | S119 | F121 | T124 | P134 | N139 | E150 | S151 | Q157 | V164 | D170 | C177 | G178 | G179 | L184 | M186 | H187 |
| 40 | R139 | Y140 | V142 | S160 | V162 | T165 | P175 | K180 | E196 | S197 | C213 | V220 | D229 | S233 | G234 | G235 | L240 | I242 | R243 |
| 41 | R139 | Y140 | V142 | S160 | V162 | T165 | P175 | K180 | E196 | S197 | C213 | V220 | D229 | S233 | G234 | G235 | L240 | I242 | R243 |
| 42 | R96 | Y97 | V99 | S117 | V119 | T122 | P132 | K137 | E151 | S152 | Q158 | V165 | D171 | S178 | A179 | A180 | L185 | M187 | K188 |
| 43 | R97 | Y98 | V100 | T118 | L120 | A123 | P133 | R138 | E147 | S148 | E154 | I161 | D167 | S174 | G175 | S176 | I181 | I183 | R184 |
| 44 | R97 | Y98 | V100 | T118 | L120 | A123 | P133 | R138 | E147 | S148 | E154 | I161 | D167 | S174 | G175 | S176 | I181 | I183 | R184 |
| 45 | R128 | Y129 | A131 | S149 | I151 | A154 | P164 | K169 | E182 | S183 | E189 | F196 | D202 | C209 | G210 | G211 | L216 | M218 | H219 |
| 46 | R128 | Y129 | A131 | S149 | I151 | A154 | P164 | K169 | E182 | S183 | E189 | F196 | D202 | C209 | G210 | — | L215 | M217 | H218 |
| 47 | — | — | — | S3 | V5 | T8 | P18 | K23 | E39 | S40 | E46 | V53 | D59 | S66 | A67 | G68 | L73 | I75 | R76 |
| 48 | R30 | Y31 | V33 | — | — | — | P47 | K52 | E68 | S69 | E75 | V82 | D88 | S95 | A96 | G97 | L102 | I104 | R105 |
| 49 | R89 | Y90 | V92 | S110 | I112 | S115 | P125 | Q130 | E140 | S141 | Q147 | V154 | D160 | S167 | G168 | G169 | L174 | M176 | R177 |
| 50 | — | — | — | — | — | — | — | — | — | — | — | — | — | — | — | — | — | — | — |
| 51 | R87 | F88 | V90 | T108 | L110 | P113 | P123 | H126 | A137 | K138 | — | V148 | E154 | F161 | A162 | G163 | L168 | V170 | R171 |
| 52 | R87 | Y88 | V90 | T108 | L110 | T113 | P123 | G126 | A136 | R137 | — | V147 | A153 | F160 | A161 | G162 | L167 | V169 | Q170 |
| 53 | R87 | Y88 | V90 | T108 | L110 | T113 | P123 | G126 | A136 | R137 | — | V147 | A153 | F160 | A161 | G162 | L167 | V169 | Q170 |
| 54 | — | — | — | — | — | — | — | — | — | — | — | — | — | — | — | — | — | — | — |
| 55 | R87 | F88 | V90 | T108 | L110 | P113 | P123 | H126 | A137 | K138 | — | V148 | E154 | F161 | A162 | G163 | L168 | V170 | R171 |
| 56 | R86 | Y87 | V89 | T107 | L109 | W112 | P122 | P125 | A135 | D136 | — | F146 | N152 | Y159 | A160 | G161 | L166 | A168 | P169 |
| 57 | R103 | Y104 | V106 | S124 | L126 | P129 | L139 | R142 | A153 | E154 | — | F164 | N170 | Y177 | A178 | G179 | L184 | A186 | R187 |
| 58 | R91 | Y92 | I94 | T112 | L114 | L117 | P127 | A130 | A141 | A142 | — | F152 | N158 | Y165 | A166 | G167 | L172 | V174 | Q175 |
| 59 | R88 | Y89 | L91 | T109 | L111 | A114 | P124 | G127 | A138 | E139 | — | V149 | N155 | Y162 | A163 | A164 | L169 | V171 | K172 |
| 60 | R88 | F89 | A91 | T109 | L111 | F114 | P124 | K127 | A138 | D139 | — | V149 | N155 | Y162 | G163 | A164 | L169 | I171 | K172 |
| 61 | R88 | F89 | V91 | T109 | L111 | T114 | P124 | A127 | A138 | S139 | — | V149 | D155 | F162 | A163 | G164 | L169 | L171 | K172 |
| 62 | R98 | Y99 | V101 | S119 | F121 | T124 | P134 | K139 | E147 | S148 | Q154 | V161 | D167 | S174 | G175 | G176 | — | — | — |
| 63 | R88 | Y89 | L91 | T109 | L111 | S114 | P124 | S127 | A138 | E139 | — | V149 | D155 | F162 | A163 | G164 | L169 | V171 | K172 |
| 64 | R97 | Y98 | A100 | S118 | L120 | M123 | A133 | K136 | A145 | E146 | — | F156 | D162 | Y169 | A170 | G171 | L176 | V178 | Q179 |
| 65 | Y98 | Y99 | M101 | T119 | L121 | W124 | P134 | L139 | S149 | V150 | Q155 | V162 | D168 | Y175 | S176 | G177 | L182 | M184 | K185 |
| 66 | R88 | F89 | I91 | S109 | I111 | L114 | P124 | K127 | A138 | D139 | — | P149 | N155 | Y162 | A163 | G164 | L169 | V171 | E172 |
| 67 | R88 | Y89 | V91 | S109 | L111 | W114 | P124 | G127 | A136 | D137 | — | F147 | N153 | Y160 | A161 | G162 | L167 | V169 | R170 |
| 68 | R88 | Y89 | V91 | T109 | L111 | I114 | P124 | K127 | A138 | D139 | — | L149 | N155 | Y162 | A163 | G164 | L169 | L171 | K172 |
| 69 | R90 | Y91 | L93 | M111 | H113 | M116 | P126 | P129 | A139 | S140 | — | V150 | D156 | Y163 | S164 | G165 | M170 | I172 | K173 |
| 70 | R86 | F87 | V89 | T107 | L109 | L112 | L122 | R125 | G136 | E137 | — | L147 | D153 | Y160 | A161 | G162 | L167 | A169 | R170 |
| 71 | R87 | F88 | A90 | S108 | L110 | P113 | P123 | S128 | E145 | S146 | Q152 | V159 | D165 | S172 | A173 | A174 | L179 | — | — |
| 72 | R105 | F106 | V108 | S126 | L128 | L131 | L141 | R144 | E155 | E156 | — | L166 | D172 | Y179 | A180 | G181 | L186 | A188 | R189 |
| 73 | R91 | F92 | L94 | T112 | L114 | W117 | P127 | N130 | A141 | A142 | — | A152 | D158 | Y165 | A166 | G167 | L172 | T174 | A175 |
| 74 | R92 | Y93 | V95 | T113 | L115 | W118 | W128 | P131 | S142 | H143 | — | A153 | D159 | Y166 | A167 | S168 | L173 | V175 | E176 |
| 75 | R92 | Y93 | V95 | T113 | L115 | W118 | W128 | P131 | S142 | H143 | — | A153 | D159 | Y166 | A167 | S168 | L173 | V175 | E176 |
| 76 | R89 | F90 | I92 | S110 | F112 | P115 | P125 | G128 | A140 | E141 | — | V151 | N157 | Y164 | A165 | A166 | L171 | L173 | K174 |
| 77 | R92 | Y93 | L95 | T113 | L115 | W118 | P128 | N131 | A142 | A143 | — | A153 | D159 | Y166 | A167 | G168 | L173 | A175 | A176 |
| 78 | R86 | F87 | Y89 | S107 | L109 | W112 | F122 | P125 | S136 | E137 | — | A147 | D153 | F160 | A161 | G162 | L167 | L169 | K170 |
| 79 | R90 | F91 | F93 | S111 | V113 | F116 | Y126 | P129 | S140 | S141 | — | A151 | D157 | F164 | A165 | G166 | L171 | V173 | K174 |
| 80 | R93 | Y94 | Y96 | S114 | L116 | A119 | A129 | P134 | T151 | Q152 | — | V162 | D168 | Y175 | A176 | G177 | L182 | V184 | R185 |
| 81 | R92 | Y93 | V95 | T113 | L115 | W118 | W128 | P131 | S142 | H143 | — | A153 | D159 | Y166 | A167 | S168 | L173 | V175 | E176 |
| 82 | R87 | Y88 | V90 | T108 | L110 | L113 | P123 | K126 | A139 | S140 | — | F150 | D156 | Y163 | A164 | G165 | L170 | L172 | E173 |
| 83 | R89 | F90 | I92 | S110 | F112 | P115 | P125 | G128 | A140 | E141 | — | V151 | N157 | Y164 | A165 | A166 | L171 | L173 | K174 |
| 84 | R101 | Y102 | Y104 | S122 | L124 | V127 | L137 | P142 | Y152 | Q153 | — | V163 | K169 | Y176 | A177 | D178 | L183 | A185 | V186 |
| 85 | R86 | Y87 | L89 | N107 | L109 | W112 | L122 | A126 | D136 | A137 | — | I147 | N153 | Y160 | A161 | G162 | L167 | I169 | H170 |
| 86 | R85 | Y86 | L88 | N106 | L108 | N111 | R121 | A126 | S134 | D135 | — | Q145 | A151 | Y158 | G159 | G160 | L165 | V167 | N168 |
| 87 | R92 | F93 | L95 | T113 | I115 | L118 | P128 | P131 | A147 | D148 | — | F158 | D164 | Y171 | A172 | S173 | L178 | M180 | A181 |
| 88 | C89 | R90 | I92 | T111 | L113 | L116 | P126 | R129 | G139 | A140 | — | F150 | D156 | Y163 | A164 | G165 | L170 | T172 | R173 |
| 89 | R84 | Y85 | F87 | N105 | F107 | W110 | L120 | T125 | A133 | D134 | — | I144 | N150 | Y157 | A158 | G159 | L164 | M166 | E167 |
| 90 | R93 | F94 | Y96 | S114 | L116 | W119 | P129 | S132 | A143 | S144 | — | A154 | S160 | F167 | A168 | G169 | M174 | I176 | R177 |
| 91 | R93 | Y94 | Y96 | S114 | L116 | V119 | L129 | A134 | R144 | Q145 | — | V155 | E161 | Y168 | A169 | G170 | L175 | A177 | L178 |
| 92 | R85 | F86 | Y88 | S106 | L108 | L111 | A121 | P126 | A143 | Q144 | — | V154 | A160 | Y167 | A168 | G169 | L174 | A176 | R177 |
| 93 | A99 | L100 | L102 | T128 | L130 | P133 | Y143 | P146 | A162 | Q163 | — | A173 | Q179 | Y186 | T187 | S188 | L193 | L195 | R196 |
| 94 | R93 | F94 | Y96 | S114 | L116 | W119 | L129 | A134 | A145 | A146 | — | A156 | Y162 | F169 | A170 | G171 | M176 | L178 | V179 |
| 95 | R87 | Y88 | L90 | G107 | L109 | W112 | P122 | S125 | A137 | D138 | — | A148 | D154 | F161 | A162 | G163 | L168 | V170 | Q171 |
| 96 | C88 | R89 | I91 | T110 | L112 | L115 | P125 | K128 | G138 | S139 | — | F149 | D155 | Y162 | A163 | G164 | L169 | T171 | R172 |
| 97 | R86 | F87 | Y89 | S107 | L109 | W112 | L122 | P125 | A135 | C152 | — | A146 | D152 | Y159 | A160 | G161 | M166 | L168 | K169 |
| 98 | R143 | F144 | L146 | F164 | L166 | I169 | A179 | P184 | E191 | S192 | R198 | V205 | E211 | Y218 | A219 | G220 | L225 | M227 | K228 |
| 99 | R112 | Y113 | V115 | S133 | V135 | T138 | P148 | K153 | E167 | S168 | Q174 | V181 | D187 | S194 | A195 | A196 | L201 | M203 | K204 |
| 100 | R146 | F147 | L149 | F167 | L169 | I172 | A182 | P187 | E194 | S195 | R201 | V208 | E214 | Y221 | A222 | G223 | L228 | M230 | K231 |
| 101 | R98 | Y99 | V101 | S119 | I121 | A124 | P134 | K139 | E152 | S153 | Q159 | V166 | D172 | S179 | A180 | G181 | L186 | M188 | C189 |
| 102 | R142 | F143 | L145 | F163 | L165 | I168 | A178 | P183 | E190 | S191 | R197 | V204 | E210 | Y217 | A218 | G219 | L224 | M226 | K227 |
| 103 | R102 | Y103 | V105 | S123 | L125 | T128 | P138 | K143 | E151 | S152 | Q158 | V165 | N171 | S178 | G179 | G180 | L185 | M187 | R188 |
| 104 | R172 | F173 | L175 | F193 | L195 | F198 | A208 | P213 | E220 | S221 | R227 | V234 | E240 | Y247 | A248 | G249 | L254 | M256 | K257 |
| 105 | R138 | F139 | L141 | F159 | L161 | I164 | A174 | P179 | E186 | S187 | R193 | V200 | E206 | Y213 | A214 | G215 | L220 | M222 | R223 |
| 106 | R97 | Y98 | V100 | S118 | L120 | T123 | P133 | K138 | E154 | S155 | E161 | V168 | D174 | S181 | A182 | G183 | L188 | I190 | R191 |

TABLE 2b-continued

| ID | | | | | | | | | | | | | | | | | | |
|---|---|---|---|---|---|---|---|---|---|---|---|---|---|---|---|---|---|---|
| 107 | R146 | F147 | L149 | F167 | L169 | I172 | A182 | P187 | E194 | S195 | R201 | V208 | E214 | Y221 | A222 | G223 | L228 | M230 | K231 |
| 108 | R167 | F168 | L170 | F188 | L190 | I193 | A203 | P208 | E215 | S216 | R222 | V229 | E235 | Y242 | A243 | G244 | L249 | M251 | K252 |
| 109 | R137 | F138 | L140 | F158 | L160 | V163 | A173 | P178 | E185 | S186 | R192 | V199 | E205 | Y212 | A213 | G214 | L219 | M221 | K222 |
| 110 | R142 | Y143 | V145 | V165 | T168 | K183 | E199 | S200 | R206 | V213 | D219 | S226 | A227 | G228 | L233 | I235 | R236 |
| 111 | R138 | F139 | L141 | F159 | L161 | I164 | A174 | P179 | E186 | S187 | R193 | V200 | E206 | Y213 | A214 | G215 | L220 | M222 | K223 |
| 112 | R95 | Y96 | A98 | S116 | F118 | T121 | P131 | N136 | E147 | S148 | Q154 | V161 | D167 | C174 | G175 | G176 | L181 | M183 | H184 |
| 113 | R153 | F154 | L156 | F174 | L176 | I179 | A189 | P194 | E201 | S202 | R208 | V215 | E221 | Y228 | A229 | G230 | L235 | M237 | K238 |
| 114 | R146 | F147 | L149 | F167 | L169 | I172 | A182 | P187 | E194 | S195 | R201 | V208 | E214 | Y221 | A222 | G223 | L228 | M230 | K231 |
| 115 | R98 | Y99 | M101 | S119 | I121 | A124 | P134 | N139 | E152 | S153 | Q159 | V166 | D172 | S179 | A180 | G181 | L186 | M188 | C189 |
| 116 | R167 | F168 | L170 | F188 | L190 | I193 | A203 | P208 | E215 | S216 | R222 | V229 | E235 | Y242 | A243 | G244 | L249 | M251 | K252 |
| 117 | R99 | Y100 | V102 | S120 | V122 | T125 | P135 | N141 | E154 | S155 | Q161 | V168 | D174 | S181 | A182 | A183 | L188 | M190 | K191 |

| Pos ID | Pos 20 | Pos 21 | Pos 22 | Pos 23 | Pos 24 | Pos 25 | Pos 26 | Pos 27 | Pos 28 | Pos 29 | Pos 30 | Pos 31 | Pos 32 | Pos 33 | Pos 34 | Pos 35 | Pos 36 | Pos 37 | Pos 38 |
|---|---|---|---|---|---|---|---|---|---|---|---|---|---|---|---|---|---|---|---|
| 1 | H220 | N227 | S234 | S246 | K259 | P260 | R261 | L295 | Q301 | G308 | S324 | R335 | G346 | F349 | L351 | D352 | T358 | L384 | L397 |
| 2 | H220 | N227 | S234 | S246 | K259 | P260 | R261 | L295 | Q301 | G308 | S324 | R335 | G346 | F349 | L351 | D352 | T358 | L384 | L397 |
| 3 | H219 | N226 | S233 | S245 | K258 | P259 | R260 | L294 | Q300 | G307 | S323 | R334 | G345 | F348 | L350 | D351 | T357 | L383 | L396 |
| 4 | H219 | N226 | S233 | S245 | K258 | P259 | R260 | L294 | Q300 | G307 | S323 | R334 | G345 | F348 | L350 | D351 | T357 | L383 | L396 |
| 5 | H220 | N227 | S234 | S246 | K260 | P261 | R262 | L296 | Q302 | G309 | S325 | R336 | G347 | F350 | L352 | D353 | T359 | L385 | L398 |
| 6 | H190 | N197 | S204 | S216 | K230 | P231 | R232 | L266 | Q272 | G279 | S295 | R306 | G317 | F320 | L322 | D323 | S329 | L355 | L368 |
| 7 | H219 | N226 | S233 | S245 | K259 | P260 | R261 | L295 | H301 | E308 | P324 | N335 | E346 | F349 | L351 | D352 | T358 | L384 | L397 |
| 8 | H192 | N199 | S206 | A218 | K232 | K234 | R235 | L269 | H275 | E282 | S300 | C311 | G322 | F325 | L327 | D328 | S334 | L360 | L373 |
| 9 | H191 | N198 | S205 | T217 | K231 | K233 | Q234 | F268 | P274 | E281 | S299 | C310 | R321 | F324 | L326 | N327 | S333 | L359 | L372 |
| 10 | H190 | D197 | S204 | A216 | K229 | K231 | R232 | L266 | H272 | E279 | S297 | C308 | G319 | F322 | L324 | N325 | S331 | L357 | L370 |
| 11 | H190 | N197 | S204 | A216 | K230 | K232 | H233 | L267 | H273 | Q280 | D294 | Y305 | G316 | F319 | L321 | N322 | S328 | L354 | L367 |
| 12 | H185 | N192 | S199 | A211 | K225 | K227 | R228 | L262 | Q268 | E275 | S293 | C304 | G315 | F318 | L320 | D321 | V327 | L353 | L366 |
| 13 | H190 | N197 | S204 | G216 | K230 | K232 | H233 | L267 | H273 | Q280 | D294 | G305 | G316 | F319 | L321 | N322 | T328 | L354 | L367 |
| 14 | H187 | N194 | S201 | S213 | K227 | K229 | R230 | L264 | H270 | E277 | S295 | C306 | G317 | F320 | L322 | D323 | N329 | L355 | L368 |
| 15 | H190 | N197 | S204 | A216 | K230 | H232 | R233 | L267 | H273 | E280 | S297 | C308 | G319 | F322 | L324 | D325 | I331 | L357 | L370 |
| 16 | H190 | N197 | S204 | A216 | K230 | H232 | R233 | L267 | H273 | E280 | S297 | C308 | G319 | F322 | L324 | D325 | I331 | L357 | L370 |
| 17 | H190 | N197 | S204 | G216 | K230 | K232 | H233 | L267 | H273 | Q280 | D294 | G305 | G316 | F319 | L321 | N322 | T328 | L354 | L367 |
| 18 | H190 | N197 | S204 | T216 | K230 | K262 | R233 | L267 | — | Q279 | I295 | C306 | G317 | F320 | L322 | N323 | A329 | L355 | L368 |
| 19 | H185 | N192 | S199 | T211 | K225 | K227 | R228 | L262 | — | Q274 | I290 | C301 | G312 | F315 | L317 | N318 | A324 | L350 | L363 |
| 20 | H188 | N195 | S202 | P214 | N228 | K230 | R231 | L265 | C271 | D278 | S296 | C307 | G318 | F321 | L323 | N324 | D330 | L356 | L369 |
| 21 | L185 | N192 | S199 | P211 | N225 | K227 | R228 | L262 | C268 | D275 | S293 | C304 | G315 | F318 | L320 | N321 | D327 | L353 | L366 |
| 22 | H192 | N199 | S206 | A218 | T232 | K234 | G235 | L269 | — | E280 | C298 | G309 | G320 | F323 | L325 | N326 | N332 | L358 | L371 |
| 23 | H196 | N203 | S210 | A222 | T236 | R238 | G239 | L273 | — | E284 | H302 | C313 | G324 | F327 | L329 | N330 | N336 | L362 | L375 |
| 24 | H192 | N199 | S203 | A215 | T229 | K231 | G232 | L266 | — | E277 | H295 | C302 | G313 | F316 | L318 | N319 | N325 | L351 | L364 |
| 25 | H238 | N245 | S249 | A261 | T275 | K277 | G278 | L312 | — | E323 | H341 | C348 | G359 | F362 | L364 | N365 | N371 | L397 | L410 |
| 26 | H161 | D168 | S175 | S187 | N197 | K199 | R200 | L234 | C240 | G246 | S263 | N274 | G285 | F288 | L290 | N291 | S297 | L323 | L336 |
| 27 | H223 | N230 | S237 | A249 | K263 | R265 | N266 | L300 | G313 | T336 | S345 | G356 | F359 | L361 | D362 | N368 | L394 | L408 |
| 28 | H225 | N232 | S239 | A251 | K265 | R267 | N268 | L302 | L308 | G315 | T336 | S347 | G358 | F361 | L363 | D364 | D370 | L396 | L410 |
| 29 | H162 | N169 | S176 | A188 | T202 | K204 | G205 | L239 | — | E250 | H268 | C279 | G290 | F293 | L295 | N296 | N302 | L328 | L341 |
| 30 | H225 | N232 | S239 | A251 | K265 | R267 | N268 | L302 | F308 | G315 | T336 | S347 | G358 | V361 | L363 | D364 | D370 | L396 | L410 |
| 31 | H225 | N232 | S239 | A251 | K265 | R267 | N268 | L302 | F308 | G315 | T336 | S347 | G358 | V361 | L363 | D364 | D370 | L396 | L410 |
| 32 | H198 | N205 | S212 | D224 | K238 | R240 | — | L274 | H280 | D287 | F308 | G319 | G330 | F333 | L335 | D336 | T342 | L368 | L381 |
| 33 | A236 | K243 | S250 | R262 | P275 | P277 | K278 | G312 | N318 | Y325 | N335 | Y346 | — | N357 | A359 | A360 | Y367 | L399 | L409 |
| 34 | H192 | N199 | S206 | A218 | K232 | K234 | R235 | L269 | Y275 | E282 | S300 | C311 | R322 | F325 | L327 | D328 | S334 | L360 | L373 |
| 35 | H279 | N286 | S293 | A305 | — | — | L331 | — | E342 | H360 | G371 | G382 | F385 | L387 | N388 | K394 | L420 | L433 |
| 36 | H229 | D236 | S243 | A255 | K269 | R271 | N272 | L306 | C312 | D319 | L340 | S351 | G362 | F365 | L367 | D368 | D374 | L400 | L414 |
| 37 | H189 | N196 | S203 | T215 | K229 | R231 | N232 | L266 | C272 | D279 | S300 | S311 | G322 | F325 | L327 | D328 | D334 | L360 | L374 |
| 38 | H196 | D203 | S210 | R222 | Q236 | K237 | R238 | L272 | L278 | N285 | S306 | — | — | — | — | T315 | L341 | L354 |
| 39 | L188 | N195 | S202 | P214 | N228 | K230 | R231 | L265 | C271 | D296 | S296 | C307 | G318 | F321 | L323 | N324 | D330 | L356 | L369 |
| 40 | H244 | N251 | S258 | T270 | K284 | R286 | N287 | L321 | C327 | G334 | S355 | G366 | G377 | F380 | L382 | D383 | D389 | L415 | L429 |
| 41 | H244 | N251 | S258 | T270 | K284 | R286 | N287 | L321 | C327 | G334 | S355 | G366 | G377 | F380 | L382 | D383 | D389 | L415 | L429 |
| 42 | H189 | N196 | S203 | A215 | T229 | K231 | G232 | L266 | — | E277 | H295 | C306 | G317 | F320 | L322 | N323 | K329 | L355 | L368 |
| 43 | H185 | S192 | S199 | K211 | T233 | P235 | R236 | T270 | Q276 | Q283 | T303 | D314 | G325 | Y328 | L330 | D331 | I337 | L363 | L377 |
| 44 | H185 | S192 | S199 | K211 | T233 | P235 | R236 | T270 | Q276 | Q283 | T303 | D314 | G325 | Y328 | L330 | D331 | I337 | L363 | L377 |
| 45 | H220 | N227 | — | — | | | | | | | | | | | | | | | |
| 46 | H219 | N226 | — | — | | | | | | | | | | | | | | | |
| 47 | H77 | N84 | S91 | A103 | K117 | R119 | N120 | L154 | F160 | G167 | T188 | S199 | G210 | Y213 | L215 | D216 | D222 | L248 | L262 |
| 48 | H106 | N113 | S120 | A132 | K146 | R148 | S149 | L183 | C189 | D196 | S217 | S228 | G239 | F242 | L244 | D245 | D251 | L277 | L291 |
| 49 | H178 | N185 | S192 | A204 | N218 | R220 | R221 | L255 | N261 | D268 | G287 | S298 | — | — | — | — | | | |
| 50 | — | — | — | S3 | K17 | K19 | H20 | L54 | D60 | S67 | S88 | R99 | G110 | Y113 | L115 | D116 | M122 | L148 | L161 |
| 51 | Y172 | E179 | S186 | — | — | A203 | P204 | L238 | — | P247 | F262 | H273 | P282 | D285 | — | R286 | E293 | L319 | L330 |
| 52 | H171 | A178 | S185 | — | — | D204 | T205 | H238 | — | W247 | S262 | H273 | P282 | D285 | — | L286 | T293 | L319 | L330 |
| 53 | H171 | S185 | S185 | — | — | D204 | T205 | H238 | — | W247 | S262 | H273 | P282 | D285 | — | L286 | T293 | L319 | L330 |
| 54 | — | — | — | — | — | — | — | — | — | S6 | G17 | V20 | L22 | D23 | D29 | L55 | L69 |
| 55 | Y172 | E179 | S186 | — | — | A203 | P204 | L238 | — | P247 | F262 | H273 | P282 | D285 | — | R286 | E293 | L319 | L330 |
| 56 | A170 | N177 | S184 | R196 | K204 | D205 | A241 | F261 | Y272 | S280 | K283 | R285 | A286 | L293 | L319 | L329 |
| 57 | Q188 | E195 | S202 | R214 | — | E219 | P220 | D254 | — | K261 | S276 | P287 | T296 | E299 | P301 | L302 | E309 | L335 | L345 |
| 58 | H176 | A183 | S190 | R202 | — | K210 | D211 | E244 | — | — | S263 | H274 | D283 | D286 | D288 | M289 | I296 | L322 | L332 |
| 59 | S173 | A180 | G187 | R199 | — | K207 | Q208 | I241 | — | — | V264 | Y275 | K283 | K286 | F288 | K289 | Y296 | L322 | L332 |
| 60 | H173 | N180 | S187 | — | G203 | F205 | F206 | I239 | S243 | — | P273 | M283 | A286 | L288 | K289 | Q295 | L321 | L331 |
| 61 | H173 | E180 | S187 | G199 | — | A207 | T208 | T241 | — | — | H272 | P281 | D284 | — | T285 | P292 | L318 | L329 |
| 62 | — | — | — | — | — | — | | | | | | | | | | | | | |
| 63 | S173 | R180 | G187 | R199 | — | K207 | Q208 | L241 | — | Q250 | T265 | Y276 | E284 | Q287 | L289 | A290 | Y297 | L323 | L333 |
| 64 | A180 | A187 | S194 | A206 | — | — | A217 | D250 | I256 | G263 | H275 | H286 | — | G297 | L299 | A300 | E307 | L333 | L343 |
| 65 | H186 | R193 | S200 | T212 | T222 | K224 | E225 | T259 | T265 | G272 | — | H292 | A303 | K306 | F308 | K309 | K316 | L342 | L352 |

TABLE 2b-continued

| | | | | | | | | | | | | | | | | | | | |
|---|---|---|---|---|---|---|---|---|---|---|---|---|---|---|---|---|---|---|---|
| 66 | H173 | Q180 | S187 | Q199 | H207 | L209 | Q210 | G244 | R250 | — | S270 | H281 | E290 | L293 | S295 | L296 | D303 | L329 | L339 |
| 67 | F171 | A178 | G185 | R197 | — | K205 | I206 | L239 | — | — | R262 | Y273 | R281 | P284 | A286 | A287 | V294 | L320 | L330 |
| 68 | Y173 | A180 | G187 | — | G204 | K206 | A207 | E240 | Q244 | — | — | H270 | — | E278 | P280 | I281 | D287 | L313 | L323 |
| 69 | A174 | E181 | S188 | K200 | G212 | K214 | M215 | T249 | — | — | R272 | Y283 | — | P294 | A296 | Y297 | R304 | L330 | L340 |
| 70 | Y171 | E178 | S185 | R197 | P209 | P211 | P212 | V246 | V252 | A257 | R283 | E294 | A303 | E306 | P308 | L309 | E316 | L342 | L352 |
| 71 | — | — | — | — | — | — | — | T184 | C190 | L197 | — | S213 | — | — | — | — | — | — | L230 |
| 72 | Y190 | E197 | S204 | R216 | P228 | P230 | P231 | V265 | V271 | A276 | R299 | E310 | A319 | E322 | P324 | L325 | E332 | L358 | L368 |
| 73 | A176 | E183 | S190 | K202 | — | K209 | M210 | V244 | — | W252 | I267 | Y278 | — | Q289 | A291 | A292 | P299 | L325 | L335 |
| 74 | A177 | R184 | G191 | R203 | G209 | S211 | P212 | V243 | — | G252 | T267 | Y278 | — | D289 | P291 | S292 | P299 | L325 | L335 |
| 75 | A177 | R184 | G191 | R203 | G209 | S211 | P212 | V243 | — | G252 | T267 | Y278 | — | D289 | P291 | S292 | P299 | L325 | L335 |
| 76 | Y175 | D182 | S189 | — | E203 | I205 | S206 | K239 | K244 | — | V264 | H275 | I285 | S288 | L290 | L291 | Y298 | L324 | L334 |
| 77 | A177 | E184 | S191 | K203 | — | K210 | M211 | V245 | — | Y253 | T268 | Y279 | — | P290 | A292 | A293 | P300 | L326 | L336 |
| 78 | A171 | Y178 | G185 | A197 | P206 | G208 | P209 | I241 | — | G250 | T265 | Y276 | — | L287 | L289 | S290 | E297 | L323 | L333 |
| 79 | A175 | H182 | G189 | K201 | T205 | G207 | P208 | V240 | — | K249 | S264 | Y275 | — | E286 | L288 | A289 | E296 | L322 | L332 |
| 80 | S186 | A193 | G200 | K212 | P224 | T226 | R227 | R261 | H267 | F274 | E284 | H295 | — | S306 | I308 | A309 | P316 | L342 | L352 |
| 81 | A177 | R184 | G191 | R203 | G209 | A211 | P212 | V243 | — | G252 | T267 | Y278 | — | E289 | P291 | S292 | P299 | L325 | L335 |
| 82 | H174 | G181 | S188 | — | G204 | A206 | Y207 | Q240 | R244 | — | F263 | H274 | E283 | A286 | P288 | L289 | E296 | L322 | L332 |
| 83 | Y175 | D182 | S189 | — | E203 | I205 | S206 | K239 | K244 | — | V264 | H275 | I285 | S288 | L290 | L291 | Y298 | L324 | L334 |
| 84 | A187 | G194 | S201 | — | P223 | P225 | K226 | Q260 | G265 | F272 | A282 | Y293 | — | P304 | A306 | S307 | L314 | L340 | L350 |
| 85 | K171 | A178 | S185 | A197 | — | — | G198 | L232 | G238 | S245 | S253 | F264 | — | P275 | A277 | A278 | H285 | L311 | A321 |
| 86 | K169 | E176 | S183 | G195 | — | V196 | F229 | G235 | A242 | E251 | L259 | H262 | — | P273 | M275 | S276 | N283 | L309 | S319 |
| 87 | D182 | Q189 | S196 | Q207 | P213 | F215 | A216 | V247 | — | G256 | R271 | A282 | — | P293 | I295 | P296 | P303 | L329 | L339 |
| 88 | L174 | N181 | S188 | P200 | — | R207 | A208 | L242 | G248 | K250 | I261 | Y272 | — | K283 | Q285 | L286 | Y293 | L318 | L328 |
| 89 | K168 | E175 | S182 | T194 | — | — | Q195 | E227 | G233 | — | K245 | Y256 | — | P267 | S269 | A270 | N277 | L303 | A313 |
| 90 | S178 | E185 | S192 | K204 | A217 | G219 | P220 | V253 | — | — | D274 | Y285 | — | A296 | M298 | A299 | P306 | L332 | L342 |
| 91 | A179 | G186 | S193 | R205 | P226 | P228 | K229 | H263 | E268 | F275 | A294 | Y305 | — | P316 | A318 | S319 | P326 | L352 | L362 |
| 92 | S178 | Q185 | G192 | R204 | P216 | V218 | R219 | E253 | N259 | F266 | E276 | Y287 | — | P298 | A300 | S301 | P308 | L334 | L344 |
| 93 | A197 | D204 | S211 | T223 | T229 | A231 | R232 | V266 | — | G275 | H290 | P301 | — | P312 | L314 | S315 | E322 | V348 | F358 |
| 94 | S180 | E187 | G194 | K206 | A219 | G221 | P222 | V255 | — | — | D276 | Y287 | — | G298 | M300 | S301 | P308 | L334 | L344 |
| 95 | A172 | A179 | S186 | A194 | — | — | E236 | — | S244 | Q255 | G266 | — | A277 | L279 | A280 | E287 | L313 | L323 |
| 96 | L173 | D180 | S187 | P199 | — | R206 | A207 | L241 | G247 | K249 | I260 | Y271 | — | K282 | Q284 | L285 | Y292 | L317 | L327 |
| 97 | A170 | R177 | G184 | A196 | P206 | G208 | P209 | V241 | — | K250 | E265 | Y276 | — | R287 | L289 | S290 | E297 | L323 | L333 |
| 98 | A229 | K236 | S243 | A254 | K269 | K270 | T271 | S304 | — | G310 | L332 | S345 | A356 | L348 | S351 | A353 | A354 | Y360 | L386 | L402 |
| 99 | H205 | N212 | S219 | A231 | K246 | K247 | G248 | L282 | T288 | E293 | H311 | C322 | G333 | F336 | L338 | N339 | K345 | L371 | L384 |
| 100 | A232 | K239 | S246 | E257 | K272 | P273 | K274 | S307 | — | G315 | — | — | L351 | A354 | A356 | D357 | Y363 | L389 | L405 |
| 101 | H190 | D197 | S204 | A216 | R230 | K231 | A232 | L266 | H272 | E279 | S297 | C308 | G319 | F322 | L324 | N325 | S331 | L357 | L370 |
| 102 | A228 | K235 | S242 | A253 | T268 | P269 | K270 | V303 | — | R311 | — | — | L347 | E350 | A352 | D353 | Y359 | L385 | L401 |
| 103 | Y189 | D196 | S203 | S215 | K226 | K227 | R228 | L262 | C268 | G274 | F292 | G303 | G303 | F317 | L319 | N320 | S326 | L352 | L365 |
| 104 | A258 | V265 | N272 | E283 | K298 | K299 | K300 | A333 | — | G341 | — | — | F377 | A380 | F382 | D383 | H389 | L415 | L431 |
| 105 | A224 | R231 | S238 | D249 | T264 | P265 | K266 | T299 | — | Q307 | — | — | L343 | D346 | A348 | D349 | Y355 | L381 | L397 |
| 106 | H192 | N199 | S206 | A218 | G233 | R234 | N235 | L269 | C275 | N282 | P303 | S314 | G325 | F328 | L330 | D331 | D337 | L363 | L377 |
| 107 | A232 | K239 | S246 | R258 | K272 | P273 | K274 | S307 | G313 | T320 | S334 | S345 | A356 | L359 | Q361 | F362 | A368 | L395 | L405 |
| 108 | A253 | K260 | S267 | R279 | K293 | P294 | K295 | S328 | L334 | T341 | S355 | S366 | A377 | L380 | F382 | A383 | F389 | L416 | L426 |
| 109 | A223 | R230 | S237 | K249 | A263 | P264 | K265 | T298 | D304 | G311 | S325 | S336 | A347 | L350 | K352 | F353 | A359 | L386 | L396 |
| 110 | H237 | N244 | S251 | A263 | G278 | R279 | N280 | L314 | C320 | D327 | S348 | S359 | G370 | F373 | L375 | D376 | D382 | L408 | L422 |
| 111 | A224 | K231 | S238 | A264 | P265 | K266 | T299 | D305 | G312 | S326 | S337 | A348 | L351 | K353 | F354 | A360 | L387 | L397 |
| 112 | L185 | N192 | S199 | P211 | K226 | K227 | R228 | L262 | C268 | D275 | S293 | C304 | G315 | F318 | L320 | N321 | D327 | L353 | L366 |
| 113 | A239 | R246 | S253 | K265 | A279 | P280 | K281 | T314 | D320 | G327 | S341 | S352 | A363 | L366 | K368 | F369 | A375 | L402 | L412 |
| 114 | A232 | K239 | S246 | R258 | K272 | P273 | K274 | S307 | G313 | T320 | S334 | S345 | A356 | L359 | Q361 | F362 | A368 | L395 | L405 |
| 115 | H190 | D197 | S204 | A216 | R230 | K231 | A232 | L266 | H272 | E279 | S297 | C308 | G319 | F322 | L324 | N325 | S331 | L357 | L370 |
| 116 | A253 | K260 | S267 | R279 | K293 | P294 | K295 | S328 | L334 | T341 | S355 | S366 | A377 | L380 | F382 | A383 | F389 | L416 | L426 |
| 117 | H192 | N199 | S206 | A218 | K233 | K234 | G235 | L269 | A275 | E280 | H298 | C309 | G320 | F323 | L325 | N326 | K332 | L358 | L371 |

| Pos ID | Pos 39 | Pos 40 | Pos 41 | Pos 42 | Pos 43 | Pos 44 | Pos 45 | Pos 46 | Pos 47 | Pos 48 | Pos 49 | Pos 50 | Pos 51 | Pos 52 | Pos 53 | Pos 54 | Pos 55 | Pos 56 |
|---|---|---|---|---|---|---|---|---|---|---|---|---|---|---|---|---|---|---|
| 1 | F417 | T418 | T419 | F420 | A432 | T434 | K438 | L449 | T451 | F462 | Y470 | S476 | V477 | D482 | Y493 | K498 | E515 | K528 |
| 2 | F417 | T418 | T419 | F420 | A432 | T434 | K438 | L449 | T451 | F462 | Y470 | S476 | V477 | D482 | Y493 | K498 | E515 | K528 |
| 3 | F416 | T417 | T418 | F419 | A431 | T433 | K437 | L448 | T450 | F461 | Y469 | C475 | V476 | D481 | Y492 | K497 | E514 | K527 |
| 4 | F416 | T417 | T418 | F419 | A431 | T433 | K437 | L448 | T450 | F461 | Y469 | S475 | V476 | D481 | Y492 | K497 | E514 | K527 |
| 5 | F418 | T419 | T420 | F421 | A433 | T435 | K439 | L450 | T452 | F463 | Y471 | S477 | V478 | D483 | Y494 | K499 | E516 | K529 |
| 6 | F388 | T389 | T390 | F391 | A403 | T405 | K409 | L420 | T422 | F433 | Y441 | S447 | V448 | D453 | Y464 | K469 | E486 | K499 |
| 7 | Y417 | T418 | T419 | F420 | A432 | T434 | K438 | L449 | T451 | Y462 | Y470 | S476 | V477 | D482 | Y493 | K498 | E515 | K525 |
| 8 | Y393 | T394 | T395 | F396 | A408 | T410 | K414 | L425 | A427 | Y438 | F446 | S452 | V453 | D458 | Y469 | K474 | D491 | K504 |
| 9 | Y392 | T393 | T394 | F395 | A407 | T409 | K413 | L424 | A426 | Y437 | Y445 | A451 | V452 | D457 | Y468 | K473 | D490 | K503 |
| 10 | Y390 | T391 | T392 | F393 | A405 | T407 | K411 | L422 | V424 | Y435 | Y443 | S449 | V450 | E455 | Y466 | K471 | E488 | K500 |
| 11 | Y387 | T388 | T389 | F390 | A402 | T404 | K408 | L419 | A420 | Y431 | Y439 | S445 | V446 | E451 | Y462 | K468 | D485 | T498 |
| 12 | Y386 | T387 | T388 | F389 | A401 | T403 | K407 | L418 | A420 | Y431 | Y439 | S445 | V446 | E451 | Y462 | K467 | E484 | K497 |
| 13 | Y387 | T388 | T389 | F390 | A402 | T404 | T408 | L419 | A421 | F432 | Y440 | S446 | V447 | D452 | Y463 | R468 | D485 | S498 |
| 14 | Y388 | T389 | T390 | F391 | A403 | K405 | K409 | L420 | A422 | Y433 | Y441 | S447 | V448 | E453 | Y464 | R469 | D486 | K499 |
| 15 | Y390 | T391 | T392 | F393 | A405 | T407 | K411 | L422 | V424 | F435 | Y443 | S449 | V450 | E455 | Y466 | K471 | E488 | K501 |
| 16 | Y390 | T391 | T392 | F393 | A405 | T407 | K411 | L422 | V424 | F435 | Y443 | S449 | V450 | E455 | Y466 | K471 | E488 | K501 |
| 17 | Y387 | T388 | T389 | F390 | A402 | T404 | K408 | L419 | A421 | Y432 | Y440 | L446 | V447 | D452 | Y463 | R468 | D485 | T498 |
| 18 | Y388 | T389 | T390 | F391 | S403 | T405 | K409 | L420 | V422 | Y433 | Y441 | S447 | V448 | E453 | Y464 | R469 | D486 | S499 |
| 19 | Y383 | T384 | T385 | F386 | S398 | T400 | K404 | L415 | V417 | Y428 | Y435 | S442 | V443 | E448 | Y459 | R464 | D481 | S499 |
| 20 | Y389 | T390 | T391 | F392 | A404 | R406 | K410 | L421 | A423 | Y434 | Y442 | S448 | V449 | E454 | Y465 | K470 | D487 | S500 |
| 21 | Y386 | T387 | T388 | F389 | A401 | R403 | K407 | L418 | A420 | C431 | Y439 | S445 | V446 | D451 | Y462 | K467 | D484 | T497 |
| 22 | Y391 | T392 | T393 | F394 | A406 | T408 | K412 | L423 | V425 | Y436 | Y444 | S450 | V451 | D456 | Y467 | R472 | D489 | K502 |
| 23 | Y395 | T396 | T397 | F398 | A410 | T412 | K416 | L427 | V429 | Y440 | Y448 | S454 | V455 | D460 | Y471 | R476 | D493 | K506 |
| 24 | Y384 | T385 | T386 | F387 | A399 | T401 | K405 | L416 | V418 | Y429 | Y437 | S443 | V444 | D449 | Y460 | R465 | D482 | K495 |

TABLE 2b-continued

| | | | | | | | | | | | | | | | | | |
|---|---|---|---|---|---|---|---|---|---|---|---|---|---|---|---|---|---|
| 25 | Y430 | T431 | T432 | F433 | A445 | T447 | K451 | L462 | V464 | Y475 | Y483 | S489 | V490 | D495 | Y506 | R511 | D528 | K541 |
| 26 | Y356 | T357 | T358 | F359 | A371 | R373 | K377 | L388 | T390 | Y401 | Y409 | S415 | V416 | E421 | Y432 | K437 | E454 | K467 |
| 27 | Y428 | T429 | T430 | F431 | A443 | T445 | K449 | L460 | V462 | Y473 | Y481 | S487 | V488 | E493 | Y504 | K509 | E526 | N539 |
| 28 | Y430 | T431 | T432 | F433 | A445 | T447 | K451 | L462 | V464 | Y475 | Y483 | S489 | V490 | E495 | Y506 | K511 | D528 | N541 |
| 29 | Y361 | T362 | T363 | F364 | A376 | T378 | K382 | L393 | V395 | Y406 | Y414 | S420 | V421 | D426 | Y437 | R442 | D459 | K472 |
| 30 | Y430 | T431 | T432 | F433 | A445 | T447 | K451 | L462 | V464 | Y475 | Y483 | S489 | V490 | E495 | Y506 | K511 | D528 | N541 |
| 31 | Y430 | T431 | T432 | F433 | A445 | T447 | K451 | L462 | V464 | Y475 | Y483 | S489 | V490 | E495 | Y506 | K511 | D528 | N541 |
| 32 | Y401 | T402 | T403 | F404 | A416 | L418 | K422 | L433 | V435 | Y446 | Y454 | L460 | V461 | D466 | Y477 | R482 | D499 | — |
| 33 | L429 | L430 | N431 | Y432 | K444 | E446 | V450 | L461 | K463 | Y476 | F484 | D490 | L491 | T496 | L509 | V514 | A531 | F544 |
| 34 | Y393 | T394 | T395 | F396 | — | — | — | L402 | C404 | Y408 | Y416 | L422 | V423 | E428 | Y439 | R444 | D461 | K474 |
| 35 | Y453 | T454 | T455 | F456 | A468 | T470 | K474 | L485 | V487 | Y498 | Y506 | S512 | V513 | D518 | Y529 | R534 | D551 | K564 |
| 36 | F434 | T435 | T436 | F437 | A449 | T451 | K455 | L466 | V468 | H479 | Y487 | L493 | A494 | G499 | Y510 | K515 | D532 | A543 |
| 37 | Y394 | T395 | S396 | F397 | A409 | T411 | K415 | L426 | V428 | Y439 | Y447 | L453 | V454 | A459 | Y470 | K475 | D492 | D505 |
| 38 | F374 | T375 | T376 | F377 | S389 | L391 | Q395 | L406 | V408 | Y419 | Y427 | S433 | V434 | A439 | F450 | R455 | D472 | T485 |
| 39 | Y389 | T390 | T391 | F392 | A404 | — | — | — | — | — | — | — | — | — | — | — | — | — |
| 40 | Y449 | T450 | S451 | F452 | A464 | T466 | K470 | L481 | V483 | H494 | Y502 | L508 | V509 | A514 | Y525 | — | K537 | — |
| 41 | Y449 | T450 | S451 | F452 | A464 | T466 | K470 | L481 | V483 | H494 | Y502 | L508 | V509 | A514 | Y525 | — | K537 | — |
| 42 | Y388 | T389 | T390 | F391 | A403 | T405 | — | — | — | — | — | — | — | — | — | — | — | — |
| 43 | F397 | T398 | T399 | F400 | R412 | K414 | L418 | I429 | V431 | Y442 | Y450 | N456 | V457 | Q462 | Y473 | R478 | E495 | K508 |
| 44 | F397 | T398 | T399 | F400 | R412 | K414 | L418 | I429 | V431 | Y442 | Y450 | N456 | V457 | Q462 | Y473 | R478 | E495 | K508 |
| 45 | — | — | — | — | — | — | — | — | — | — | — | — | — | — | — | — | — | — |
| 46 | — | — | — | — | — | — | — | — | — | — | — | — | — | — | — | — | — | — |
| 47 | Y282 | T283 | T284 | F285 | A297 | T299 | K303 | L314 | V316 | Y327 | Y335 | S341 | V342 | E347 | Y358 | K363 | D380 | N393 |
| 48 | F311 | T312 | T313 | F314 | A326 | T328 | K332 | L343 | V345 | H356 | Y364 | S370 | A371 | G376 | — | K383 | D400 | V413 |
| 49 | — | — | — | — | — | — | — | — | — | — | — | — | — | — | — | — | — | — |
| 50 | Y181 | T182 | T183 | F184 | A196 | L198 | R202 | L213 | V215 | Y226 | Y234 | M240 | V241 | E246 | Y257 | S262 | — | — |
| 51 | L350 | T351 | T352 | F353 | L365 | E367 | E371 | L382 | I384 | R395 | Y403 | A409 | V410 | H415 | L426 | M431 | R448 | G461 |
| 52 | L350 | T351 | T352 | F353 | S365 | A367 | Q371 | L382 | V384 | H395 | Y403 | T409 | V410 | D415 | F426 | R431 | — | A458 |
| 53 | L350 | T351 | T352 | F353 | S365 | A367 | Q371 | L382 | V384 | H395 | Y403 | T409 | V410 | D415 | F426 | R431 | — | T458 |
| 54 | Y89 | T90 | T91 | F92 | A104 | T106 | K110 | L121 | V123 | Y134 | Y142 | S148 | V149 | E154 | Y165 | K170 | D187 | N200 |
| 55 | L350 | T351 | T352 | F353 | L365 | E367 | E371 | L382 | I384 | R395 | Y403 | A409 | V410 | H415 | L426 | M431 | R448 | G461 |
| 56 | F349 | T350 | T351 | F352 | K364 | D366 | K370 | V381 | L383 | R394 | Y402 | K408 | I409 | D414 | F425 | R430 | E447 | — |
| 57 | L365 | T366 | V367 | M368 | L380 | A382 | L386 | L397 | V399 | F410 | Y418 | F424 | F425 | A430 | M441 | R446 | E463 | — |
| 58 | L352 | S353 | T354 | Y355 | L367 | D369 | D373 | L384 | V386 | Y397 | Y405 | K411 | I412 | N417 | F428 | R433 | Q450 | — |
| 59 | F352 | T353 | L354 | F355 | E367 | R369 | L373 | M384 | I386 | F397 | Y405 | E411 | H412 | D417 | I428 | R433 | N450 | — |
| 60 | L351 | T352 | N353 | Y354 | L366 | R368 | R372 | L383 | V385 | V396 | Y404 | E410 | Y411 | D416 | L427 | R432 | A449 | — |
| 61 | L349 | T350 | T351 | F352 | A364 | D366 | R370 | L381 | V383 | A394 | Y402 | A408 | A409 | E414 | F425 | R430 | R447 | V460 |
| 62 | — | — | — | — | — | — | — | — | — | — | — | — | — | — | — | — | — | — |
| 63 | F353 | T354 | L355 | F356 | M368 | K370 | I374 | M385 | I387 | L398 | Y406 | E412 | H413 | E418 | L429 | R434 | K451 | — |
| 64 | L363 | S364 | A365 | F366 | G378 | D380 | L384 | L395 | I397 | R408 | Y416 | E422 | L423 | S428 | L439 | R444 | E461 | — |
| 65 | L373 | T374 | V375 | Y376 | R388 | A390 | V394 | L405 | V407 | T418 | Y426 | E432 | S433 | A438 | F449 | R454 | E471 | — |
| 66 | I359 | N360 | T361 | M362 | L374 | D376 | R380 | L391 | V403 | H404 | M412 | L418 | V419 | I424 | L435 | R440 | E457 | — |
| 67 | L350 | T351 | T352 | F353 | L365 | N367 | I371 | L382 | L384 | R395 | Y403 | E409 | I410 | D415 | F426 | R431 | E448 | — |
| 68 | L343 | T344 | V345 | F346 | P358 | T360 | L364 | L375 | I377 | H388 | Y396 | K402 | V403 | T408 | L419 | R424 | N441 | — |
| 69 | T360 | I361 | N362 | L363 | Q375 | D377 | I381 | I392 | A394 | R405 | Y413 | E419 | A420 | E425 | F436 | R441 | E458 | A471 |
| 70 | L372 | T373 | V374 | L375 | M387 | L389 | M393 | L404 | V406 | V417 | Y425 | R431 | F432 | E437 | V448 | R453 | R470 | — |
| 71 | — | — | — | — | — | — | — | — | — | — | — | — | — | — | — | — | — | — |
| 72 | L388 | T389 | V390 | L391 | M403 | L405 | M409 | L420 | V422 | V433 | Y441 | R447 | F448 | E453 | V464 | R469 | R486 | — |
| 73 | T355 | T356 | T357 | L358 | R370 | D372 | I376 | L387 | I389 | R400 | Y408 | E414 | R415 | V420 | F431 | R436 | E453 | A466 |
| 74 | L355 | T356 | V357 | F358 | A370 | D372 | E376 | L387 | V389 | R400 | L408 | E414 | T415 | R420 | L429 | L434 | E451 | — |
| 75 | L355 | T356 | V357 | F358 | A370 | D372 | E376 | L387 | V389 | R400 | L408 | E414 | T415 | R420 | L429 | L434 | E451 | — |
| 76 | L354 | T355 | T356 | Y357 | L369 | Q371 | L375 | L386 | I388 | L399 | P407 | D413 | R414 | S419 | I430 | I435 | — | — |
| 77 | T356 | I357 | T358 | L359 | Q371 | E373 | I377 | L388 | I390 | R401 | Y409 | E415 | R416 | E421 | L432 | R437 | E454 | A467 |
| 78 | I353 | R354 | V355 | M355 | L368 | D370 | V374 | M385 | I387 | Y406 | E412 | R413 | F418 | L429 | Y434 | R451 | — | — |
| 79 | I352 | R353 | A354 | M355 | A367 | E369 | A373 | M384 | I386 | K397 | Y405 | E411 | K412 | F417 | I428 | R433 | E450 | — |
| 80 | L372 | S373 | N374 | Y375 | M387 | D389 | V393 | L404 | A406 | L418 | Y426 | N432 | R433 | D438 | L449 | I454 | S471 | N484 |
| 81 | L355 | T356 | V357 | F358 | T370 | D372 | E376 | L387 | V389 | R400 | F408 | E414 | T415 | R420 | L429 | L434 | E451 | — |
| 82 | L352 | T353 | V354 | M355 | L367 | Q369 | L373 | L384 | L386 | S397 | Y405 | W412 | K417 | L428 | F433 | E450 | — | — |
| 83 | L354 | T355 | T356 | F357 | L369 | Q371 | L375 | L386 | I388 | L399 | P407 | D413 | R414 | S419 | I430 | I435 | — | — |
| 84 | F370 | L371 | S372 | F373 | L394 | P396 | A400 | L411 | T413 | L425 | Y433 | Q439 | R440 | Q445 | V457 | L462 | Q479 | — |
| 85 | F341 | T342 | T343 | F344 | Q356 | E358 | K362 | — | D374 | L387 | Y395 | — | R398 | H403 | S416 | R421 | D438 | — |
| 86 | I339 | T340 | S341 | Y342 | L354 | E356 | L360 | — | Q372 | L385 | F393 | — | Y396 | H401 | I414 | Y419 | A436 | — |
| 87 | L359 | T360 | V361 | F362 | L380 | D382 | L380 | L391 | V393 | R404 | S412 | E418 | R419 | D424 | L433 | L438 | E455 | — |
| 88 | Y348 | A349 | F350 | F351 | K363 | D365 | R369 | L380 | Y382 | R395 | Y403 | S409 | R410 | D415 | L426 | K431 | E448 | — |
| 89 | I333 | T334 | S335 | F336 | L348 | D350 | K354 | — | K366 | R378 | Y386 | — | D389 | H394 | V407 | E412 | E429 | — |
| 90 | L362 | R363 | S364 | M365 | L377 | D379 | M383 | M394 | I396 | R407 | Y415 | K421 | R422 | Q427 | L438 | Y443 | D460 | — |
| 91 | L382 | I383 | S384 | F385 | L406 | P408 | A412 | L423 | V425 | L437 | Y445 | Q451 | R452 | Q457 | V469 | L474 | Q491 | — |
| 92 | L364 | T365 | N366 | F367 | L379 | N381 | V385 | L396 | K398 | L410 | Y418 | L424 | R425 | N430 | L441 | T446 | P463 | — |
| 93 | L378 | R379 | T380 | F381 | H393 | D395 | N399 | L410 | V412 | R423 | Y431 | Q437 | L438 | E443 | L454 | Y459 | D476 | — |
| 94 | L364 | R365 | S366 | M367 | L379 | D381 | V385 | M396 | I398 | R409 | Y417 | R423 | R424 | E429 | L440 | Y445 | D462 | — |
| 95 | L343 | T344 | A345 | T346 | R357 | D359 | L363 | L374 | T387 | Y395 | D401 | R402 | D407 | F418 | R423 | Q440 | — | — |
| 96 | Y347 | A348 | C349 | F350 | K362 | D364 | I368 | L379 | Y381 | R394 | Y402 | A408 | R409 | D414 | L425 | K430 | E447 | — |
| 97 | I353 | R354 | V355 | M356 | K368 | E370 | T374 | M385 | I387 | R398 | Y406 | E412 | K413 | F418 | F429 | Y434 | E451 | — |
| 98 | L422 | L423 | N424 | Y425 | K437 | E439 | V443 | L454 | S458 | V469 | F477 | D483 | L484 | K489 | L502 | V507 | T524 | — |
| 99 | Y404 | T405 | T406 | F407 | A419 | T421 | K425 | L436 | V437 | Y457 | S463 | V464 | D469 | Y480 | R485 | E502 | N515 | — |
| 100 | L425 | L426 | N427 | Y428 | K440 | E442 | V446 | L457 | N461 | V472 | F480 | D486 | L487 | K492 | L505 | V510 | A527 | — |
| 101 | Y390 | T391 | T392 | F393 | A405 | T407 | K411 | L422 | V424 | Y435 | Y443 | S449 | V450 | E455 | Y466 | K471 | D488 | K500 |
| 102 | L421 | L422 | N423 | Y424 | K436 | E438 | V442 | L453 | K457 | V468 | F476 | D482 | I483 | K488 | L501 | V506 | A523 | — |
| 103 | Y385 | T386 | T387 | F388 | A400 | R402 | K406 | L417 | A419 | Y430 | Y438 | L444 | V445 | E450 | Y461 | K466 | E483 | K496 |
| 104 | I451 | L452 | S453 | F454 | K466 | Q468 | A472 | L483 | S487 | V498 | F506 | D512 | L513 | K518 | L531 | V536 | A553 | — |

TABLE 2b-continued

| 105 | L417 | L418 | N419 | Y420 | K432 | E434 | V438 | L449 | T453 | V464 | F472 | D478 | R479 | K484 | L497 | V502 | S519 | — |
| --- | --- | --- | --- | --- | --- | --- | --- | --- | --- | --- | --- | --- | --- | --- | --- | --- | --- | --- |
| 106 | F397 | T398 | T399 | F400 | A412 | T414 | K418 | L429 | V431 | H442 | Y450 | S456 | A457 | G462 | Y473 | K478 | D495 | D508 |
| 107 | L425 | L426 | N427 | Y428 | K440 | E442 | V446 | L457 | N461 | V472 | F480 | D486 | L487 | K492 | L505 | V510 | A527 | — |
| 108 | I446 | L447 | S448 | Y449 | K461 | K463 | A467 | L478 | D482 | V493 | F501 | D507 | L508 | K513 | L526 | V531 | A548 | — |
| 109 | L416 | L417 | N418 | Y419 | K431 | E433 | V437 | L448 | R452 | V463 | F471 | D477 | R478 | K483 | L496 | V501 | S518 | — |
| 110 | F442 | T443 | T444 | F445 | A457 | T459 | K463 | L474 | V476 | H487 | Y495 | L501 | A502 | G507 | Y518 | K523 | D540 | G549 |
| 111 | L417 | L418 | N419 | Y420 | K432 | E434 | V438 | L449 | R453 | V464 | F472 | D478 | R479 | K484 | L497 | V502 | S519 | — |
| 112 | Y386 | T387 | T388 | F389 | A401 | R403 | K407 | L418 | A420 | C431 | Y439 | S445 | V446 | D451 | Y462 | K467 | D484 | S494 |
| 113 | L432 | L433 | N434 | Y435 | K447 | E449 | V453 | L464 | R468 | V479 | F487 | D493 | R494 | K499 | L512 | V517 | S534 | — |
| 114 | L425 | L426 | N427 | Y428 | K440 | E442 | V446 | L457 | N461 | V472 | F480 | D486 | L487 | K492 | L505 | V510 | A527 | — |
| 115 | Y390 | T391 | T392 | F393 | A405 | T407 | K411 | L422 | V424 | Y435 | Y443 | S449 | V450 | E455 | Y466 | K471 | D488 | S497 |
| 116 | I446 | L447 | S448 | Y449 | K461 | K463 | A467 | L478 | D482 | V493 | F501 | D507 | L508 | K513 | L526 | V531 | A548 | — |
| 117 | Y391 | T392 | T393 | F394 | A406 | T408 | K412 | L423 | V425 | Y436 | Y444 | S450 | V451 | D456 | Y467 | R472 | D489 | K502 |

Assays to test for the functionality of such mutants are readily available in the art, and respectively, described in the Example section of the present invention.

In a preferred embodiment, the mutated PPO refers to a polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, or 117, in which the amino acid sequence differs at Mutated site 1 (which corresponds to Arg128 of SEQ ID NO: 1) according to Table 2a, and/or at Mutated site 5 (which corresponds to Phe420 of SEQ ID NO: 1) according to Table 2a.

Examples of differences at these amino acid positions include, but are not limited to, one or more of the following:

the amino acid at Mutated site 1 is other than Arginine (or Tryosine, or Cysteine; as the case may be according to Table 2a);

the amino acid at Mutated site 5 is other than Phenylalanine (or Methionine, or Tyrosine, or Leucine, as the case may be according to Table 2a), In particularly preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 (which corresponds to Arg128 of SEQ ID NO: 1) is Leu, Ala, Val, Ile, Met, Tyr, Gly, Asn, Cys, Phe, Ser, Thr, Gln, or His, and the amino acid at Mutated site 5 (which corresponds to Phe420 of SEQ ID NO: 1) is Ala, Leu, Val, le, or Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Leu, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Leu, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Leu, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Leu, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Leu, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ala, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ala, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ala, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ala, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ala, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Val, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Val, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Val, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Val, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Val, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ile, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ile, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ile, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ile, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ile, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Met, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Met, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Met, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Met, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Met, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Tyr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Tyr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Tyr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Tyr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Tyr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gly, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gly, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gly, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gly, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gly, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Asn, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Asn, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Asn, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Asn, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Asn, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Cys, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Cys, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Cys, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Cys, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Cys, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Phe, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 1 is Phe, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Phe, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Phe, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Phe, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ser, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ser, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ser, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ser, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Ser, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Thr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Thr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Thr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Thr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Thr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gln, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gln, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gln, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gln, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is Gln, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is His, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is His, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is His, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is His, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 1 is His, and the amino acid at Mutated site 5 is Met.

In another preferred embodiment, the mutated PPO refers to a polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, or 117, in which the amino acid sequence differs at Mutated site 4 (which corresponds to Leu397 of SEQ ID NO: 1) according to Table 2a, and/or at Mutated site 5 (which corresponds to Phe420 of SEQ ID NO: 1) according to Table 2a.

Examples of differences at these amino acid positions include, but are not limited to, one or more of the following:

the amino acid at Mutated site 4 is other than Leucine (or Alanine, or Serine, or Phenylalanine, as the case may be according to Table 2a);

the amino acid at Mutated site 5 is other than Phenylalanine (or Methionine, or Tyrosine, or Leucine, as the case may be according to Table 2a), In particularly preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 (which corresponds to Leu397 of SEQ ID NO: 1) is Ala, Arg, Val, Ile, Met, His, Lys, Asp, Glu, Ser, Thr, Asn, Gln, Cys, Gly, Pro, Phe, Tyr, or Trp, and the amino acid at Mutated site 5 (which corresponds to Phe420 of SEQ ID NO: 1) is Ala, Leu, Val, lie, Met, His, Lys, Asp, Glu, Ser, Thr, Asn, Gln, Cys, Gly, Pro, Arg, Tyr, or Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 100, 101, 102, 103, 104, 105, 106, 107, 108, 109, 110, 111, 112, 113, 114, 115, 116, 117 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ala, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Arg, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Arg, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Val, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Val, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Val, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Iie, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Iie, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Iie, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Iie, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Iie, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Iie, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ile, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Met, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Met, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is His, and the amino acid at Mutated site 5 is Gly.

In another 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Lys, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Lys, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asp, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Glu, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Glu, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Glu, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Ser, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Ser, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Thr, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Asn, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Gln, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gln, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Cys, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Gly, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which: the amino acid at Mutated site 4 is Pro, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:
the amino acid at Mutated site 4 is Pro, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Pro, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Phe, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Tyr, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 4 is Trp, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 3 is other than Gly, is preferably Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 6 is other than Gly, is preferably Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, a variant, derivative, orthologue, paralogue or homologue thereof, in which:

the amino acid at Mutated site 7 is other than Leu, is preferably Phe.

It will be within the knowledge of the skilled artisan to identify conserved regions and motifs shared between the homologues, orthologues and paralogues of PPO polypeptides comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637. Having identified such conserved regions that may represent suitable binding motifs, amino acids corresponding to the amino acids listed in Table 2a and 2b can be chosen to be substituted by any other amino acid, preferably by the amino acids listed under mutated sites 1, 2, 3, 4, or 5.

Accordingly, preferred motifs shared between the homologues, orthologues and paralogues of PPO polypeptides described above are Motif 1: SQ[N/K/H]KRYI, wherein the Arg at position 5 within said motif is substituted by Leu, Ala, Val, Ile, Met, Tyr, Gly, Asn, Cys, Phe, Ser, Thr, Gln, or His; Motif 2: TLGTLFSS, wherein the Leu at position 2 within said motif is substituted by Ala, Arg, Val, Ile, Met, His, Lys, Asp, Glu, Ser, Thr, Asn, Gln, Cys, Gly, Pro, Phe, Tyr, or Trp; and/or wherein the Gly at position 3 within said motif is substituted by Ala, Arg, Val, Ile, Met, His, Lys, Asp, Glu, Ser, Thr, Asn, Gln, Cys, Leu, Pro, Phe, Tyr, or Trp; and/or wherein the Leu at position 5 within said motif is substituted by Ala, Arg, Val, Ie, Met, His, Lys, Asp, Glu, Ser, Thr, Asn, Gln, Cys, Gly, Pro, Phe, Tyr, or Trp; Motif 3: [F/Y]TTF[V/I]GG, wherein the Phe at position 4 within said motif is substituted by Ala, Leu, Val, Ile, Met, His, Lys, Asp, Glu, Ser, Thr, Asn, Gln, Cys, Gly, Pro, Arg, Tyr, or Trp.

Further examples of such homologues, orthologues and paralogues are PPO polypeptides comprising the amino acid sequence of SEQ ID NO: 577, 579, 581, 583, 585, 587, 589, 591, 593, 595, 597, 599, 601, 603, 605, 607, 609, 611, 613, 615, 617, 619, 621, 623, 625, 627, or 637.

In addition, the present invention refers to a method for identifying a uracilpyridine herbicide by using a herbicide tolerant PPO polypeptide as defined SUPRA.

Said method comprises the steps of:
a) generating a transgenic cell or plant comprising a nucleic acid encoding a mutated PPO, wherein the mutated PPO is expressed;

b) applying a uracilpyridine herbicide to the transgenic cell or plant of a) and to a control cell or plant of the same variety;

c) determining the growth or the viability of the transgenic cell or plant and the control cell or plant after application of said uracilpyridine herbicide, and d) selecting "uracilpyridine herbicides" which confer reduced growth to the control cell or plant as compared to the growth of the transgenic cell or plant.

By "control cell" or "similar, wild-type, plant, plant tissue, plant cell or host cell" is intended a plant, plant tissue, plant cell, or host cell, respectively, that lacks the herbicide-resistance characteristics and/or particular polynucleotide of the invention that are disclosed herein. The use of the term "wild-type" is not, therefore, intended to imply that a plant, plant tissue, plant cell, or other host cell lacks recombinant DNA in its genome, and/or does not possess herbicide-resistant characteristics that are different from those disclosed herein.

Another object refers to a method of identifying a nucleotide sequence encoding a mutated PPO which is resistant or tolerant to a uracilpyridine herbicide, the method comprising:

a) generating a library of mutated PPO-encoding nucleic acids, b) screening a population of the resulting mutated PPO-encoding nucleic acids by expressing each of said nucleic acids in a cell or plant and treating said cell or plant with a uracilpyridine herbicide, c) comparing the uracilpyridine herbicide-tolerance levels provided by said population of mutated PPO encoding nucleic acids with the uracilpyridine herbicide-tolerance level provided by a control PPO-encoding nucleic acid, d) selecting at least one mutated PPO-encoding nucleic acid that provides a significantly increased level of tolerance to a uracilpyridine herbicide as compared to that provided by the control PPO-encoding nucleic acid.

In a preferred embodiment, the mutated PPO-encoding nucleic acid selected in step d) provides at least 2-fold as much resistance or tolerance of a cell or plant to a uracilpyridine herbicide as compared to that provided by the control PPO-encoding nucleic acid.

In a further preferred embodiment, the mutated PPO-encoding nucleic acid selected in step d) provides at least 2-fold, at least 5-fold, at least 10-fold, at least 20-fold, at least 50-fold, at least 100-fold, at least 500-fold, as much resistance or tolerance of a cell or plant to a uracilpyridine herbicide as compared to that provided by the control PPO-encoding nucleic acid.

The resistance or tolerance can be determined by generating a transgenic plant or host cell, preferably a plant cell, comprising a nucleic acid sequence of the library of step a) and comparing said transgenic plant with a control plant or host cell, preferably a plant cell.

Another object refers to a method of identifying a plant or algae containing a nucleic acid comprising a nucleotide sequence encoding a wild-type or mutated PPO which is resistant or tolerant to a uracilpyridine herbicide, the method comprising:

a) identifying an effective amount of a uracilpyridine herbicide in a culture of plant cells or green algae that leads to death of said cells.

b) treating said plant cells or green algae with a mutagenizing agent, c) contacting said mutagenized cells population with an effective amount of uracilpyridine herbicide, identified in a), d) selecting at least one cell surviving these test conditions, e) PCR-amplification and sequencing of PPO genes from cells selected in d) and comparing such sequences to wild-type PPO gene sequences, respectively.

In a preferred embodiment, said mutagenizing agent is ethylmethanesulfonate (EMS). Many methods well known to the skilled artisan are available for obtaining suitable candidate nucleic acids for identifying a nucleotide sequence encoding a mutated PPO from a variety of different potential source organisms including microbes, plants, fungi, algae, mixed cultures etc. as well as environmental sources of DNA such as soil. These methods include inter alia the preparation of cDNA or genomic DNA libraries, the use of suitably degenerate oligonucleotide primers, the use of probes based upon known sequences or complementation assays (for example, for growth upon tyrosine) as well as the use of mutagenesis and shuffling in order to provide recombined or shuffled mutated PPO-encoding sequences.

Nucleic acids comprising candidate and control PPO encoding sequences can be expressed in yeast, in a bacterial host strain, in an alga or in a higher plant such as tobacco or *Arabidopsis* and the relative levels of inherent tolerance of the PPO encoding sequences screened according to a visible indicator phenotype of the transformed strain or plant in the presence of different concentrations of the selected uracilpyridine herbicide. Dose responses and relative shifts in dose responses associated with these indicator phenotypes (formation of brown color, growth inhibition, herbicidal effect etc) are conveniently expressed in terms, for example, of GR50 (concentration for 50% reduction of growth) or MIC (minimum inhibitory concentration) values where increases in values correspond to increases in inherent tolerance of the expressed PPO. For example, in a relatively rapid assay system based upon transformation of a bacterium such as *E. coli*, each mutated PPO encoding sequence may be expressed, for example, as a DNA sequence under expression control of a controllable promoter such as the lacZ promoter and taking suitable account, for example by the use of synthetic DNA, of such issues as codon usage in order to obtain as comparable a level of expression as possible of different PPO sequences. Such strains expressing nucleic acids comprising alternative candidate PPO sequences may be plated out on different concentrations of the selected uracilpyridine herbicide in, optionally, a tyrosine supplemented medium and the relative levels of inherent tolerance of the expressed PPO enzymes estimated on the basis of the extent and MIC for inhibition of the formation of the brown, ochronotic pigment.

In another embodiment, candidate nucleic acids are transformed into plant material to generate a transgenic plant, regenerated into morphologically normal fertile plants which are then measured for differential tolerance to selected uracilpyridine herbicides as described in the Example section hereinafter. Many suitable methods for transformation using suitable selection markers such as kanamycin, binary vectors such as from *Agrobacterium* and plant regeneration as, for example, from tobacco leaf discs are well known in the art. Optionally, a control population of plants is likewise transformed with a nucleic acid expressing the control PPO. Alternatively, an untransformed dicot plant such as *Arabidopsis* or Tobacco can be used as a control since this, in any case, expresses its own endogenous PPO. The average, and distribution, of herbicide tolerance levels of a range of primary plant transformation events or their progeny to uracilpyridine herbicides described supra are evaluated in the normal manner based upon plant damage, meristematic bleaching symptoms etc. at a range of different concentrations of herbicides. These data can be expressed in terms of, for example, GR50 values derived from dose/response curves having "dose" plotted on the x-axis and "percentage kill", "herbicidal effect", "numbers of emerging green plants" etc. plotted on the y-axis where increased GR50 values correspond to increased levels of inherent tolerance of the expressed PPO. Herbicides can suitably be applied pre-emergence or post-emergence.

In another embodiment, the invention refers to a plant cell transformed by a nucleic acid encoding a herbicide tolerant PPO polypeptide disclosed herein or to a plant cell which has been mutated to obtain a plant expressing a nucleic acid encoding a mutated PPO polypeptide according to the present invention, wherein expression of the nucleic acid in the plant cell results in increased resistance or tolerance to a uracilpyridine herbicide as compared to a wild type variety of the plant cell.

The term "expression/expressing" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

To obtain the desired effect, i.e. plants that are tolerant or resistant to the uracilpyridine herbicide derivative herbicide of the present invention, it will be understood that the at least one nucleic acid is "over-expressed" by methods and means known to the person skilled in the art.

The term "increased expression" or "overexpression" as used herein means any form of expression that is additional to the original wild-type expression level. Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994)

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transforrmation using viruses or pollen and microprojection.

Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter ala from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229). The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

Preferably, the wild-type or mutated PPO nucleic acid comprises a polynucleotide sequence selected from the group consisting of: a) a polynucleotide encoding a polypeptide as shown in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, or a variant or derivative thereof; b) a polynucleotide comprising at least 60 consecutive nucleotides of any of a); and c) a polynucleotide complementary to the polynucleotide of any of a) through b).

Preferably, the expression of the nucleic acid in the plant results in the plant's increased resistance to uracilpyridine herbicide as compared to a wild type variety of the plant.

In another embodiment, the invention refers to a plant, preferably a transgenic plant, comprising a plant cell according to the present invention, wherein expression of the nucleic acid in the plant results in the plant's increased resistance to uracilpyridine herbicide as compared to a wild type variety of the plant.

The plants described herein can be either transgenic crop plants or non-transgenic plants. For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues in order to allow for the expression of the mutated PPO of the present invention. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein. Furthermore, the term "transgenic" refers to any plant, plant cell, callus, plant tissue, or plant part, that contains all or part of at least one recombinant polynucleotide. In many cases, all or part of the recombinant polynucleotide is stably integrated into a chromosome or stable extra-chromosomal element, so that it is passed on to successive generations. For the purposes of the invention, the term "recombinant polynucleotide" refers to a polynucleotide that has been altered, rearranged, or modified by genetic engineering. Examples include any cloned polynucleotide, or polynucleotides, that are linked or joined to heterologous sequences. The term "recombinant" does not refer to alterations of polynucleotides that result from naturally occurring events, such as spontaneous mutations, or from non-spontaneous mutagenesis followed by selective breeding.

Plants containing mutations arising due to non-spontaneous mutagenesis and selective breeding are referred to herein as non-transgenic plants and are included in the present invention. In embodiments wherein the plant is transgenic and comprises multiple mutated PPO nucleic acids, the nucleic acids can be derived from different genomes or from the same genome. Alternatively, in embodiments wherein the plant is non-transgenic and comprises multiple mutated PPO nucleic acids, the nucleic acids are located on different genomes or on the same genome.

As used herein, "mutagenized" refers to an organism or DNA thereof having alteration(s) in the biomolecular sequence of its native genetic material as compared to the sequence of the genetic material of a corresponding wild-type organism or DNA, wherein the alteration(s) in genetic material were induced and/or selected by human action. Methods of inducing mutations can induce mutations in random positions in the genetic material or can induce mutations in specific locations in the genetic material (i.e., can be directed mutagenesis techniques), such as by use of a genoplasty technique.

In certain embodiments, the present invention involves herbicide-resistant plants that are produced by mutation breeding. Such plants comprise a polynucleotide encoding a mutated PPO and are tolerant to one or more uracilpyridine herbicides. Such methods can involve, for example, exposing the plants or seeds to a mutagen, particularly a chemical mutagen such as, for example, ethyl methanesulfonate (EMS) and selecting for plants that have enhanced tolerance to at least one or more uracilpyridine herbicide.

However, the present invention is not limited to herbicide-tolerant plants that are produced by a mutagenesis method involving the chemical mutagen EMS. Any mutagenesis method known in the art may be used to produce the herbicide-resistant plants of the present invention. Such mutagenesis methods can involve, for example, the use of any one or more of the following mutagens: radiation, such as X-rays, Gamma rays (e.g., cobalt 60 or cesium 137), neutrons, (e.g., product of nuclear fission by uranium 235 in an atomic reactor), Beta radiation (e.g., emitted from radioisotopes such as phosphorus 32 or carbon 14), and ultraviolet radiation (preferably from 2500 to 2900 nm), and chemical mutagens such as base analogues (e.g., 5-bromo-uracil), related compounds (e.g., 8-ethoxy caffeine), antibiotics (e.g., streptonigrin), alkylating agents (e.g., sulfur mustards, nitrogen mustards, epoxides, ethylenamines, sulfates, sulfonates, sulfones, lactones), azide, hydroxylamine, nitrous acid, or acridines. Herbicide-resistant plants can also be produced by using tissue culture methods to select for plant cells comprising herbicide-resistance mutations and then regenerating herbicide-resistant plants therefrom. See, for example, U.S. Pat. Nos. 5,773,702 and 5,859,348, both of which are herein incorporated in their entirety by reference. Further details of mutation breeding can be found in "Principals of Cultivar Development" Fehr, 1993 Macmillan Publishing Company the disclosure of which is incorporated herein by reference Alternatively, herbicide-resistant plants according to the present invention can also be produced by using genome editing methods to select for plant cells comprising herbicide-resistance mutations and then regenerating herbicide-resistant plants therefrom. "Genome Editing" refers to a type of genetic engineering in which DNA is inserted, deleted or replaced in the genome of an organism using engineered nucleases. These nucleases are known to the skilled artisan to create site-specific double-strand breaks at desired locations in the genome. The induced double-strand breaks are repaired through nonhomologous end-joining or homologous recombination, resulting in targeted mutations. Known in the art are currently four families of engineered nucleases which can be used for the purposes of the present invention: meganucleases, zinc finger nucleases (ZFNs), transcription activator-like effector-based nucleases (TALEN), and the CRISPR-Cas system. For references, see, for example, Esvelt, K M. and Wang, H H. (2013) "*Genome-scale engineering for systems and synthetic biology*", *Mol Syst Biol.* 9 (1): 641; Tan, W S. et al., (2012) "*Precision editing of large animal genomes*" *Adv Genet.* 80: 37-97; Puchta, H. and Fauser, F. (2013) "*Gene targeting in plants: 25 years later*", *Int. J. Dev. Biol.* 57 629-637 Boglioli, Elsy and Richard, Magali "*Rewriting the book of life: a new era in precision genome editing*", *Boston Consulting Group*, Retrieved Nov. 30, 2015; Method of the Year 2011. Nat Meth 9 (1), 1-1.

Consequently, in another embodiment, the invention refers to a non-transgenic plant, comprising a plant cell according to the present invention, wherein expression of the nucleic acid encoding a mutated PPO in the plant results in the plant's increased resistance to uracilpyridine herbicide as compared to a wild type variety of the plant.

In addition to the definition above, the term "plant" is intended to encompass crop plants at any stage of maturity or development, as well as any tissues or organs (plant parts) taken or derived from any such plant unless otherwise clearly indicated by context. Plant parts include, but are not limited to, stems, roots, flowers, ovules, stamens, leaves, embryos, meristematic regions, callus tissue, anther cultures, gametophytes, sporophytes, pollen, microspores, protoplasts, and the like.

The plant of the present invention comprises at least one mutated PPO nucleic acid or over-expressed wild-type PPO nucleic acid, and has increased tolerance to a uracilpyridine herbicide as compared to a wild-type variety of the plant. It is possible for the plants of the present invention to have multiple wild-type or mutated PPO nucleic acids from different genomes since these plants can contain more than one genome. For example, a plant contains two genomes, usually referred to as the A and B genomes. Because PPO is a required metabolic enzyme, it is assumed that each genome has at least one gene coding for the PPO enzyme (i.e. at least one PPO gene). As used herein, the term "PPO gene locus" refers to the position of an PPO gene on a genome, and the terms "PPO gene" and "PPO nucleic acid" refer to a nucleic acid encoding the PPO enzyme. The PPO nucleic acid on each genome differs in its nucleotide sequence from an PPO nucleic acid on another genome. One of skill in the art can determine the genome of origin of each PPO nucleic acid through genetic crossing and/or either sequencing methods or exonuclease digestion methods known to those of skill in the art.

The present invention includes plants comprising one, two, three, or more mutated PPO alleles, wherein the plant has increased tolerance to a uracilpyridine herbicide as compared to a wild-type variety of the plant. The mutated PPO alleles can comprise a nucleotide sequence selected from the group consisting of a polynucleotide encoding a polypeptide as defined in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565,or a variant or derivative, homologue, orthologue, paralogue thereof, a polynucleotide comprising at least 60 consecutive nucleotides of any of the aforementioned polynucleotides; and a polynucleotide complementary to any of the aforementioned polynucleotides.

In a particularly preferred embodiment, the mutagenized plant refers to a rice plant of the species *Oryza sativa* which comprises a mutated PPO allele which comprises a polynucleotide encoding a polypeptide as defined in SEQ ID NO: 628, 629, 630, 631, 632, 633, 634, 635, or 636.

Preferably, the polynucleotide comprises a nucleic acid sequence as defined in SEQ ID NO: 638, 639, 640, 641, 642, 643, 644, 645, 646, 647, 648,or 649.

Said mutated rice lines were deposited under the terms of the Budapest Treaty on Nov. 8, 2017, and have been assigned the NCIMB accession numbers 42873, 42876, 42878, 42871, 42874, 42875, 42870, 42877,and 42872.

"Alleles" or "allelic variants" are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms The term "variety" refers to a group of plants within a species defined by the sharing of a common set of characteristics or traits accepted by those skilled in the art as sufficient to distinguish one cultivar or variety from another cultivar or variety. There is no implication in either term that all plants of any given cultivar or variety will be genetically identical at either the whole gene or molecular level or that any given plant will be homozygous at all loci. A cultivar or variety is considered "true breeding" for a particular trait if, when the true-breeding cultivar or variety is self-pollinated, all of the progeny contain the trait. The terms "breeding line" or "line" refer to a group of plants within a cultivar defined by the sharing of a common set of characteristics or traits accepted by those skilled in the art as sufficient to distinguish one breeding line or line from another breeding line or line. There is no implication in either term that all plants of any given breeding line or line will be genetically identical at either the whole gene or molecular level or that any given plant will be homozygous at all loci. A breeding line or line is considered "true breeding" for a particular trait if, when the true-breeding line or breeding line is self-pollinated, all of the progeny contain the trait. In the present invention, the trait arises from a mutation in a PPO gene of the plant or seed.

In some embodiments, traditional plant breeding is employed whereby the uracilpyridine herbicides-tolerant trait is introduced in the progeny plant resulting therefrom. In one embodiment, the present invention provides a method for producing a uracilpyridine herbicides-tolerant progeny plant, the method comprising: crossing a parent plant with a uracilpyridine herbicides-tolerant plant to introduce the uracilpyridine herbicides-tolerance characteristics of the uracilpyridine herbicides-tolerant plant into the germplasm of the progeny plant, wherein the progeny plant has increased tolerance to the uracilpyridine herbicides relative to the parent plant. In other embodiments, the method further comprises the step of introgressing the uracilpyridine herbicides-tolerance characteristics through traditional plant breeding techniques to obtain a descendent plant having the uracilpyridine herbicides-tolerance characteristics.

The herbicide-resistant plants of the invention that comprise polynucleotides encoding mutated PPO polypeptides also find use in methods for increasing the herbicide-resistance of a plant through conventional plant breeding involving sexual reproduction. The methods comprise crossing a first plant that is a herbicide-resistant plant of the invention to a second plant that may or may not be resistant to the same herbicide or herbicides as the first plant or may be resistant to different herbicide or herbicides than the first plant. The second plant can be any plant that is capable of producing viable progeny plants (i.e., seeds) when crossed with the first plant. Typically, but not necessarily, the first and second plants are of the same species. The methods can optionally involve selecting for progeny plants that comprise the mutated PPO polypeptides of the first plant and the herbicide resistance characteristics of the second plant. The progeny plants produced by this method of the present invention have increased resistance to a herbicide when compared to either the first or second plant or both. When the first and second plants are resistant to different herbicides, the progeny plants will have the combined herbicide tolerance characteristics of the first and second plants. The methods of the invention can further involve one or more generations of backcrossing the progeny plants of the first cross to a plant of the same line or genotype as either the first or second plant. Alternatively, the progeny of the first cross or any subsequent cross can be crossed to a third plant that is of a different line or genotype than either the first or second plant. The present invention also provides plants, plant organs, plant tissues, plant cells, seeds, and non-human host cells that are transformed with the at least one polynucleotide molecule, expression cassette, or transformation vector of the invention. Such transformed plants, plant organs, plant tissues, plant cells, seeds, and non-human host cells have enhanced tolerance or resistance to at least one herbicide, at levels of the herbicide that kill or inhibit the growth of an untransformed plant, plant tissue, plant cell, or non-human host cell, respectively. Preferably, the transformed plants, plant tissues, plant cells, and seeds of the invention are *Arabidopsis thaliana* and crop plants.

In other aspects, plants of the invention include those plants which, in addition to being tolerant to uracilpyridine herbicides, have been subjected to further genetic modifications by breeding, mutagenesis or genetic engineering, e.g. have been rendered tolerant to applications of specific other classes of herbicides, such as AHAS inhibitors; auxinic herbicides; bleaching herbicides such as hydroxyphenylpyruvate dioxygenase (HPPD) inhibitors or phytoene desaturase (PDS) inhibitors; EPSPS inhibitors such as glyphosate; glutamine synthetase (GS) inhibitors such as glufosinate; lipid biosynthesis inhibitors such as acetyl CoA carboxylase (ACCase) inhibitors; or oxynil {i.e. bromoxynil or ioxynil) herbicides as a result of conventional methods of breeding or genetic engineering, Thus, uracilpyridine herbicides-tolerant plants of the invention can be made resistant to multiple classes of herbicides through multiple genetic modifications, such as resistance to both glyphosate and glufosinate or to both glyphosate and a herbicide from another class such as HPPD inhibitors, AHAS inhibitors, or ACCase inhibitors. These herbicide resistance technologies are, for example, described in Pest Management Science (at volume, year, page):61, 2005, 246; 61, 2005, 258; 61, 2005, 277; 61, 2005, 269; 61, 2005, 286; 64, 2008, 326; 64, 2008, 332; Weed Science 57, 2009, 108; Australian Journal of Agricultural Research 58, 2007, 708; Science 316, 2007, 1185; and references quoted therein. For example, uracilpyridine herbicides-tolerant plants of the invention, in some embodiments, may be tolerant to ACCase inhibitors, such as "dims" {e.g., cycloxydim, sethoxydim, clethodim, or tepraloxydim), "fops" {e.g., clodinafop, diclofop, fluazifop, haloxyfop, or quizalofop), and "dens" (such as pinoxaden); to auxinic herbicides, such as dicamba; to EPSPS inhibitors, such as glyphosate; to other PPO inhibitors; and to GS inhibitors, such as glufosinate.

In addition to these classes of inhibitors, uracilpyridine herbicides-tolerant plants of the invention may also be tolerant to herbicides having other modes of action, for example, chlorophyll/carotenoid pigment inhibitors, cell membrane disrupters, photosynthesis inhibitors, cell division inhibitors, root inhibitors, shoot inhibitors, and combinations thereof.

Such tolerance traits may be expressed, e.g.: as mutant or wildtype PPO proteins, as mutant AHASL proteins, mutant ACCase proteins, mutant EPSPS proteins, or mutant glutamine synthetase proteins; or as mutant native, inbred, or transgenic aryloxyalkanoate dioxygenase (AAD or DHT), haloarylnitrilase (BXN), 2,2-dichloropropionic acid dehalogenase (DEH), glyphosate-N-acetyltransferase (GAT), glyphosate decarboxylase (GDC), glyphosate oxidoreductase (GOX), glutathione-S-transferase (GST), phosphinothricin acetyltransferase (PAT or bar), or CYP450s proteins having an herbicide-degrading activity.

uracilpyridine herbicides-tolerant plants hereof can also be stacked with other traits including, but not limited to, pesticidal traits such as Bt Cry and other proteins having pesticidal activity toward coleopteran, lepidopteran, nematode, or other pests; nutrition or nutraceutical traits such as modified oil content or oil profile traits, high protein or high amino acid concentration traits, and other trait types known in the art.

Furthermore, in other embodiments, uracilpyridine herbicides-tolerant plants are also covered which are, by the use of recombinant DNA techniques and/or by breeding and/or otherwise selected for such characteristics, rendered able to synthesize one or more insecticidal proteins, especially those known from the bacterial genus *Bacillus*, particularly from *Bacillus thuringiensis*, such as [delta]-endotoxins, e.g. CryIA(b), CryIA(c), CryIF, CryIF(a2), CryIIA(b), CryIIIA, CryIIIB(b1) or Cry9c; vegetative insecticidal proteins (VIP), e.g. VIP1, VIP2, VIP3 or VIP3A; insecticidal proteins of bacteria colonizing nematodes, e.g. *Photorhabdus* spp. or *Xenorhabdus* spp.; toxins produced by animals, such as scorpion toxins, arachnid toxins, wasp toxins, or other insect-specific neurotoxins; toxins produced by fungi, such streptomycete toxins; plant lectins, such as pea or barley lectins; agglutinins; proteinase inhibitors, such as trypsin inhibitors, serine protease inhibitors, patatin, cystatin or papain inhibitors; ribosome-inactivating proteins (RIP), such as ricin, maize-RIP, abrin, luffin, saporin or bryodin; steroid metabolism enzymes, such as 3-hydroxy-steroid oxidase, ecdysteroid-IDP-glycosyl-transferase, cholesterol oxidases, ecdysone inhibitors or HMG-CoA-reductase; ion channel blockers, such as blockers of sodium or calcium channels; juvenile hormone esterase; diuretic hormone receptors (helicokinin receptors); stilben synthase, bibenzyl synthase, chitinases or glucanases. In the context of the present invention these insecticidal proteins or toxins are to be understood expressly also as pre-toxins, hybrid proteins, truncated or otherwise modified proteins. Hybrid proteins are characterized by a new combination of protein domains, (see, e.g. WO 02/015701). Further examples of such toxins or genetically modified plants capable of synthesizing such toxins are disclosed, e.g., in EP-A 374 753, WO 93/007278, WO 95/34656, EP-A 427 529, EP-A 451 878, WO 03/18810 und WO 03/52073. The methods for producing such genetically modified plants are generally known to the person skilled in the art and are described, e.g. in the publications mentioned above. These insecticidal proteins contained in the genetically modified plants impart to the plants producing these proteins tolerance to harmful pests from all taxonomic groups of arthropods, especially to beetles (Coeloptera), two-winged insects (Diptera), and moths (Lepidoptera) and to nematodes (Nematoda).

In some embodiments, expression of one or more protein toxins (e.g., insecticidal proteins) in the uracilpyridine herbicides-tolerant plants is effective for controlling organisms that include, for example, members of the classes and orders: Coleoptera such as the American bean weevil *Acanthoscelides obtectus*; the leaf beetle Agelastica alni; click beetles (*Agriotes lineatus, Agriotes obscurus, Agriotes bicolor*); the grain beetle Ahasverus advena; the summer schafer Amphimallon *solstitialis*; the furniture beetle Anobium punctatum; *Anthonomus* spp. (weevils); the Pygmy mangold beetle *Atomaria linearis*; carpet beetles (*Anthrenus* spp., *Attagenus* spp.); the cowpea weevil Callosobruchus maculates; the fried fruit beetle *Carpophilus hemipterus*; the cabbage seedpod weevil *Ceutorhynchus assimilis*; the rape winter stem weevil *Ceutorhynchus picitarsis*; the wireworms *Conoderus vespertinus* and *Conoderus falli*; the banana weevil *Cosmopolites sordidus*; the New Zealand grass grub *Costelytra zealandica*; the June beetle *Cotinis nitida*; the sunflower stem weevil *Cylindrocopturus adspersus*; the larder beetle *Dermestes lardarius*; the corn rootworms *Diabrotica virgifera, Diabrotica virgifera virgifera*, and *Diabrotica barberi*; the Mexican bean beetle *Epilachna varivestis*; the old house borer *Hylotropes bajulus*; the lucerne weevil *Hypera postica*; the shiny spider beetle *Gibbium psylloides*; the cigarette beetle *Lasioderma serricorne*; the Colorado potato beetle *Leptinotarsa decemlineata*; Lyctus beetles {*Lyctus* spp., the pollen beetle *Meligethes aeneus*; the common cockshafer *Melolontha melolontha*; the American spider beetle *Mezium americanum*; the golden spider beetle Niptus hololeuc s; the grain beetles *Oryzaephilus surinamensis* and *Oryzaephilus Mercator*; the black vine weevil *Otiorhynchus sulcatus*; the mustard beetle *Phaedon cochleariae*, the crucifer flea beetle *Phyllotreta cruciferae*; the striped flea beetle *Phyllotreta striolata*; the cabbage steam flea beetle *Psylliodes chrysocephala; Ptinus* spp. (spider beetles); the lesser grain borer *Rhizopertha dominica*; the pea and been weevil *Sitona lineatus*; the rice and granary beetles *Sitophilus oryzae* and *Sitophilus granaries*; the red sunflower seed weevil *Smicronyx fulvus*; the drugstore beetle *Stegobium paniceum*; the yellow mealworm beetle *Tenebrio molitor*, the flour beetles *Tribolium castaneum* and *Tribolium confusum*; warehouse and cabinet beetles {*Trogoderma* spp.); the sunflower beetle *Zygogramma exclamationis; Dermaptera* (earwigs) such as the European earwig *Forficula auricularia* and the striped earwig *Labidura riparia; Dictyoptera* such as the oriental cockroach *Blatta orientalis*; the greenhouse millipede *Oxidus gracilis*; the beet fly *Pegomyia betae*; the frit fly *Oscinella frit*; fruitflies (*Dacus* spp., *Drosophila* spp.); *Isoptera* (termites) including species from the familes Hodotermitidae, Kalotermitidae, Mastotermitidae, Rhinotermitidae, Serritermitidae, Termitidae, Termopsidae; the tarnished plant bug *Lygus lineolaris*; the black bean aphid *Aphis fabae*; the cotton or melon aphid *Aphis gossypii*; the green apple aphid *Aphis pomi*; the citrus spiny whitefly *Aleurocanthus spiniferus*; the sweet potato whitefly *Bemesia tabaci*; the cabbage aphid *Brevicoryne brassicae*; the pear psylla *Cacopsylla pyricola*; the currant aphid *Cryptomyzus ribis*; the grape phylloxera *Daktulosphaira vitifoliae*; the citrus psylla *Diaphorina citri*; the potato leafhopper *Empoasca fabae*; the bean leafhopper *Empoasca Solana*; the vine leafhopper *Empoasca vitis*; the woolly aphid *Eriosoma lanigerum*; the European fruit scale *Eulecanium corni*; the mealy plum aphid *Hyalopterus arundinis*; the small brown planthopper *Laodelphax striatellus*; the potato aphid *Macrosiphum euphorbiae*; the green peach aphid *Myzus persicae*; the green rice leafhopper *Nephotettix cinticeps*; the brown planthopper *Nilaparvata lugens*; the hop aphid *Phorodon humuli*; the bird-cherry aphid *Rhopalosiphum padi*; the grain aphid *Sitobion avenae*; Lepidoptera such as *Adoxophyes orana* (summer fruit *tortrix* moth); *Archips podana* (fruit tree *tortrix* moth); *Bucculatrix* pyrivorella (pear leafminer); *Bucculatrix thurberiella* (cotton leaf perforator); *Bupalus piniarius* (pine looper); *Carpocapsa pomonella* (codling moth); *Chilo suppressalis* (striped rice borer); *Choristoneura fumiferana* (eastern spruce budworm); *Cochylis hospes* (banded sunflower moth); *Diatraea grandiosella* (southwestern corn borer); *Eupoecilia ambiguella* (European grape berry moth); *Helicoverpa armigera* (cotton bollworm); *Helicoverpa zea* (cotton bollworm); *Heliothis* vires cens (tobacco budworm), *Homeosoma elec-* tellum (sunflower moth); *Homona magnanima* (oriental tea tree *tortrix* moth); *Lithocolletis blancardella* (spotted tentiform leafminer); *Lymantria dispar* (gypsy moth); *Malacosoma neustria* (tent caterpillar); *Mamestra brassicae* (cabbage armyworm); *Mamestra configurata* (Bertha armyworm); *Operophtera brumata* (winter moth); *Ostrinia nubilalis* (European corn borer), *Panolis flammea* (pine beauty moth), *Phyllocnistis citrella* (citrus leafminer); *Pieris brassicae* (cabbage white butterfly); *Rachiplusia ni* (soybean looper); *Spodoptera exigua* (beet armyworm); *Spodoptera littoralis* (cotton leafworm); *Sylepta derogata* (cotton leaf roller); *Trichoplusia ni* (cabbage looper); Orthoptera such as the common cricket *Acheta domesticus*, tree locusts (*Anacridium* spp.), the migratory locust *Locusta migratoria*, the twostriped grasshopper *Melanoplus bivittatus*, the differential grasshopper *Melanoplus differ entialis*, the red-legged grasshopper *Melanoplus femurrubrum*, the migratory grasshopper *Melanoplus sanguinipes*, the northern mole cricket *Neocurtilla hexadectyla*, the red locust *Nomadacris septemfasciata*, the shortwinged mole cricket *Scapteriscus abbreviatus*, the southern mole cricket *Scapteriscus borellii*, the tawny mole cricket *Scapteriscus vicinus*, and the desert locust *Schistocerca gregaria;* Symphyla such as the garden symphylan *Scutigerella immaculata;* Thysanoptera such as the tobacco *thrips Frankliniella fusca*, the flower *thrips Frankliniella intonsa*, the western flower *thrips Frankliniella occidentalism* the cotton bud *thrips Frankliniella schultzei*, the banded greenhouse *thrips Hercinothrips femoralis*, the soybean *thrips Neohydatothrips variabilis*, Kelly's citrus *thrips Pezothrips kellyanus*, the avocado *thrips Scirtothrips perseae*, the melon *thrips Thrips palmi*, and the onion *thrips Thrips tabaci*; and the like, and combinations comprising one or more of the foregoing organisms.

In some embodiments, expression of one or more protein toxins (e.g., insecticidal proteins) in the uracilpyridine herbicides-tolerant plants is effective for controlling flea beetles, i.e. members of the flea beetle tribe of family Chrysomelidae, preferably against *Phyllotreta* spp., such as *Phyllotreta cruciferae* and/or *Phyllotreta triolata*. In other embodiments, expression of one or more protein toxins {e.g., insecticidal proteins) in the uracilpyridine herbicides-tolerant plants is effective for controlling cabbage seedpod weevil, the Bertha armyworm, *Lygus* bugs, or the diamondback moth.

Furthermore, in one embodiment, uracilpyridine herbicides-tolerant plants are also covered which are, e.g. by the use of recombinant DNA techniques and/or by breeding and/or otherwise selected for such traits, rendered able to synthesize one or more proteins to increase the resistance or tolerance of those plants to bacterial, viral or fungal pathogens. The methods for producing such genetically modified plants are generally known to the person skilled in the art.

Furthermore, in another embodiment, uracilpyridine herbicides-tolerant plants are also covered which are, e.g. by the use of recombinant DNA techniques and/or by breeding and/or otherwise selected for such traits, rendered able to synthesize one or more proteins to increase the productivity (e.g. oil content), tolerance to drought, salinity or other growth-limiting environmental factors or tolerance to pests and fungal, bacterial or viral pathogens of those plants.

Furthermore, in other embodiments, uracilpyridine herbicides-tolerant plants are also covered which are, e.g. by the use of recombinant DNA techniques and/or by breeding and/or otherwise selected for such traits, altered to contain a modified amount of one or more substances or new substances, for example, to improve human or animal nutrition, e.g. oil crops that produce health-promoting long-chain omega-3 fatty acids or unsaturated omega-9 fatty acids (e.g. Nexera® rape, Dow Agro Sciences, Canada).

Furthermore, in some embodiments, uracilpyridine herbicides-tolerant plants are also covered which are, e.g. by the use of recombinant DNA techniques and/or by breeding and/or otherwise selected for such traits, altered to contain increased amounts of vitamins and/or minerals, and/or improved profiles of nutraceutical compounds.

In one embodiment, uracilpyridine herbicides-tolerant plants of the present invention, relative to a wild-type plant, comprise an increased amount of, or an improved profile of, a compound selected from the group consisting of: glucosinolates (e.g., glucoraphanin (4-methylsulfinylbutyl-glucosinolate), sulforaphane, 3-indolylmethyl-glucosinolate (glucobrassicin), I-methoxy-3-indolylmethyl-glucosinolate (neoglucobrassicin)); phenolics (e.g., flavonoids (e.g., quercetin, kaempferol), hydroxycinnamoyl derivatives (e.g., 1,2,2'-trisinapoylgentiobiose, 1,2-diferuloylgentiobiose, I,2'-disinapoyl-2-feruloylgentiobiose, 3-0-caffeoyl-quinic (neochlorogenic acid)); and vitamins and minerals (e.g., vitamin C, vitamin E, carotene, folic acid, niacin, riboflavin, thiamine, calcium, iron, magnesium, potassium, selenium, and zinc).

In another embodiment, uracilpyridine herbicides-tolerant plants of the present invention, relative to a wild-type plant, comprise an increased amount of, or an improved profile of, a compound selected from the group consisting of: progoitrin; isothiocyanates; indoles (products of glucosinolate hydrolysis); glutathione; carotenoids such as beta-carotene, lycopene, and the xanthophyll carotenoids such as lutein and zeaxanthin; phenolics comprising the flavonoids such as the flavonols (e.g. quercetin, rutin), the flavans/tannins (such as the procyanidins comprising coumarin, proanthocyanidins, catechins, and anthocyanins); flavones; phytoestrogens such as coumestans, lignans, resveratrol, isoflavones e.g. genistein, daidzein, and glycitein; resorcyclic acid lactones; organosulphur compounds; phytosterols; terpenoids such as carnosol, rosmarinic acid, glycyrrhizin and saponins; chlorophyll; chlorphyllin, sugars, anthocyanins, and vanilla. In other embodiments, uracilpyridine herbicides-tolerant plants of the present invention, relative to a wild-type plant, comprise an increased amount of, or an improved profile of, a compound selected from the group consisting of: vincristine, vinblastine, taxanes (e.g., taxol (paclitaxel), baccatin III, 10-desacetylbaccatin III, 10-desacetyl taxol, xylosyl taxol, 7-epitaxol, 7-epibaccatin III, 10-desacetylcephalomannine, 7-epicephalomannine, taxotere, cephalomannine, xylosyl cephalomannine, taxagifine, 8-benxoyloxy taxagifine, 9-acetyloxy taxusin, 9-hydroxy taxusin, taiwanxam, taxane Ia, taxane Ib, taxane Ic, taxane Id, GMP paclitaxel, 9-dihydro 13-acetylbaccatin III, 10-desacetyl-7-epitaxol, tetrahydrocannabinol (THC), cannabidiol (CBD), genistein, diadzein, codeine, morphine, quinine, shikonin, ajmalacine, serpentine, and the like.

It is to be understood that the plant of the present invention can comprise a wild type PPO nucleic acid in addition to a mutated PPO nucleic acid. It is contemplated that the uracilpyridine herbicide tolerant lines may contain a mutation in only one of multiple PPO isoenzymes. Therefore, the present invention includes a plant comprising one or more mutated PPO nucleic acids in addition to one or more wild type PPO nucleic acids.

In another embodiment, the invention refers to a seed produced by a transgenic plant comprising a plant cell of the present invention, wherein the seed is true breeding for an increased resistance to a uracilpyridine herbicide as compared to a wild type variety of the seed.

In another embodiment, the invention refers to a method of producing a transgenic plant cell with an increased resistance to a uracilpyridine herbicide as compared to a wild type variety of the plant cell comprising, transforming the plant cell with an expression cassette comprising a mutated PPO nucleic acid.

In another embodiment, the invention refers to a method of producing a transgenic plant comprising, (a) transforming a plant cell with an expression cassette comprising a mutated PPO nucleic acid, and (b) generating a plant with an increased resistance to uracilpyridine herbicide from the plant cell.

Consequently, mutated PPO nucleic acids of the invention are provided in expression cassettes for expression in the plant of interest. The cassette will include regulatory sequences operably linked to a mutated PPO nucleic acid sequence of the invention. The term "regulatory element" as used herein refers to a polynucleotide that is capable of regulating the transcription of an operably linked polynucleotide. It includes, but not limited to, promoters, enhancers, introns, 5' UTRs, and 3' UTRs. By "operably linked" is intended a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The cassette may additionally contain at least one additional gene to be cotransformed into the organism. Alternatively, the additional gene(s) can be provided on multiple expression cassettes.

In a preferred embodiment, the expression cassette comprises the sequence of SEQ ID NO:240, 241, 242, 243, 244, 245, 246, 247, 248, 249, 250, 251, 252, 253, 254, 255, 256, 257, 258, 259, 260, 261, 262, or 264.

Such an expression cassette is provided with a plurality of restriction sites for insertion of the mutated PPO nucleic acid sequence to be under the transcriptional regulation of the regulatory regions. The expression cassette may additionally contain selectable marker genes.

The expression cassette of the present invention will include in the 5'-3' direction of transcription, a transcriptional and translational initiation region (i.e., a promoter), a mutated PPO encoding nucleic acid sequence of the invention, and a transcriptional and translational termination region (i.e., termination region) functional in plants. The promoter may be native or analogous, or foreign or heterologous, to the plant host and/or to the mutated PPO nucleic acid sequence of the invention. Additionally, the promoter may be the natural sequence or alternatively a synthetic sequence. Where the promoter is "foreign" or "heterologous" to the plant host, it is intended that the promoter is not found in the native plant into which the promoter is introduced. Where the promoter is "foreign" or "heterologous" to the mutated PPO nucleic acid sequence of the invention, it is intended that the promoter is not the native or naturally occurring promoter for the operably linked mutated PPO nucleic acid sequence of the invention. As used herein, a chimeric gene comprises a coding sequence operably linked to a transcription initiation region that is heterologous to the coding sequence.

While it may be preferable to express the mutated PPO nucleic acids of the invention using heterologous promoters, the native promoter sequences may be used. Such constructs would change expression levels of the mutated PPO protein in the plant or plant cell. Thus, the phenotype of the plant or plant cell is altered.

The termination region may be native with the transcriptional initiation region, may be native with the operably linked mutated PPO sequence of interest, may be native with the plant host, or may be derived from another source (i.e., foreign or heterologous to the promoter, the mutated PPO nucleic acid sequence of interest, the plant host, or any combination thereof). Convenient termination regions are available from the Ti-plasmid of *A. tumefaciens*, such as the octopine synthase and nopaline synthase termination regions. See also Guerineau et al. (1991) Mol. Gen. Genet. 262: 141-144; Proudfoot (1991) Cell 64:671-674; Sanfacon et al. (1991) Genes Dev. 5: 141-149; Mogen et al. (1990) Plant Cell 2: 1261-1272; Munroe et al. (1990) Gene 91: 151-158; Ballas t al. (1989) Nucleic Acids Res. 17:7891-7903; and Joshi et al. (1987) Nucleic Acid Res. 15:9627-9639. Where appropriate, the gene(s) may be optimized for increased expression in the transformed plant. That is, the genes can be synthesized using plant-preferred codons for improved expression. See, for example, Campbell and Gowri (1990) Plant Physiol. 92: 1-11 for a discussion of host-preferred codon usage. Methods are available in the art for synthesizing plant-preferred genes. See, for example, U.S. Pat. Nos. 5,380,831, and 5,436,391, and Murray et al. (1989) Nucleic Acids Res. 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures. Nucleotide sequences for enhancing gene expression can also be used in the plant expression vectors. These include the introns of the maize Adhl, intronl gene (Callis et al. Genes and Development 1: 1183-1200, 1987), and leader sequences, (W-sequence) from the Tobacco Mosaic virus (TMV), Maize Chlorotic Mottle Virus and Alfalfa Mosaic Virus (Gallie et al. Nucleic Acid Res. 15:8693-8711, 1987 and Skuzeski et al. Plant Mol. Biol. 15:65-79, 1990). The first intron from the shrunken-1 locus of maize, has been shown to increase expression of genes in chimeric gene constructs. U.S. Pat. Nos. 5,424,412 and 5,593,874 disclose the use of specific introns in gene expression constructs, and Gallie et al. (Plant Physiol. 106:929-939, 1994) also have shown that introns are useful for regulating gene expression on a tissue specific basis. To further enhance or to optimize mutated PPO gene expression, the plant expression vectors of the invention may also contain DNA sequences containing matrix attachment regions (MARs). Plant cells transformed with such modified expression systems, then, may exhibit overexpression or constitutive expression of a nucleotide sequence of the invention.

The expression cassettes of the present invention may additionally contain 5' leader sequences in the expression cassette construct. Such leader sequences can act to enhance translation. Translation leaders are known in the art and include: picornavirus leaders, for example, EMCV leader (Encephalomyocarditis 5' noncoding region) (Elroy-Stein et al. (1989) Proc. Natl. Acad. ScL USA 86:6126-6130); potyvirus leaders, for example, TEV leader (Tobacco Etch Virus)

(Gallie et al. (1995) Gene 165(2):233-238), MDMV leader (Maize Dwarf Mosaic Virus) (Virology 154:9-20), and human immunoglobulin heavy-chain binding protein (BiP) (Macejak et al. (1991) Nature 353:90-94); untranslated leader from the coat protein mRNA of alfalfa mosaic virus (AMV RNA 4) (Jobling et al. (1987) Nature 325:622-625); tobacco mosaic virus leader (TMV) (Gallie et al. (1989) in Molecular Biology of RNA, ed. Cech (Liss, New York), pp. 237-256); and maize chlorotic mottle virus leader (MCMV) (Lommel et al. (1991) Virology 81:382-385). See also, Della-Cioppa et al. (1987) Plant Physiol. 84:965-968. Other methods known to enhance translation can also be utilized, for example, introns, and the like.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and trans versions, may be involved.

A number of promoters can be used in the practice of the invention. The promoters can be selected based on the desired outcome. The nucleic acids can be combined with constitutive, tissue-preferred, or other promoters for expression in plants. Such constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) Nature 313:810-812); rice actin (McElroy et al. (1990) Plant Cell 2: 163-171); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Velten et al. (1984) EMBO J. 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Tissue-preferred promoters can be utilized to target enhanced mutated PPO expression within a particular plant tissue. Such tissue-preferred promoters include, but are not limited to, leaf-preferred promoters, root-preferred promoters, seed-preferred promoters, and stem-preferred promoters. Tissue-preferred promoters include Yamamoto et al. (1997) Plant J. 12(2):255-265; Kawamata et al. (1997) Plant Cell Physiol. 38(7):792-803; Hansen et al. (1997) Mol. Gen Genet. 254(3):337-343; Russell et al. (1997) Transgenic Res. 6(2): 157-168; Rinehart et al. (1996) Plant Physiol. 112(3): 1331-1341; Van Camp et al. (1996) Plant Physiol. 112(2):525-535; Canevascini et al. (1996) Plant Physiol. 112(2):513-524; Yamamoto et al. (1994) Plant Cell Physiol. 35(5):773-778; Lam (1994) Results Probl. Cell Differ. 20: 181-196; Orozco et al. (1993) Plant Mol Biol. 23(6): 1129-1138; Matsuoka e/[alpha]/. (1993) Proc Natl. Acad. Sci. USA 90(20):9586-9590; and Guevara-Garcia et al. (1993) Plant J. 4(3):495-505. Such promoters can be modified, if necessary, for weak expression. In one embodiment, the nucleic acids of interest are targeted to the chloroplast for expression. In this manner, where the nucleic acid of interest is not directly inserted into the chloroplast, the expression cassette will additionally contain a chloroplast-targeting sequence comprising a nucleotide sequence that encodes a chloroplast transit peptide to direct the gene product of interest to the chloroplasts. Such transit peptides are known in the art. With respect to chloroplast-targeting sequences, "operably linked" means that the nucleic acid sequence encoding a transit peptide (i.e., the chloroplast-targeting sequence) is linked to the mutated PPO nucleic acid of the invention such that the two sequences are contiguous and in the same reading frame. See, for example, Von Heijne et al. (1991) Plant Mol. Biol. Rep. 9: 104-126; Clark et al. (1989) J. Biol. Chem. 264:17544-17550; Della-Cioppa et al. (1987) Plant Physiol. 84:965-968; Romer et al. (1993) Biochem. Biophys. Res. Commun. 196:1414-1421; and Shah et al. (1986) Science 233:478-481. While the mutated PPO proteins of the invention include a native chloroplast transit peptide, any chloroplast transit peptide known in the art can be fused to the amino acid sequence of a mature mutated PPO protein of the invention by operably linking a chloroplast-targeting sequence to the 5'-end of a nucleotide sequence encoding a mature mutated PPO protein of the invention. Chloroplast targeting sequences are known in the art and include the chloroplast small subunit of ribulose-1, 5-bisphosphate carboxylase (Rubisco) (de Castro Silva Filho et al. (1996) Plant Mol. Biol. 30:769-780; Schnell et al. (1991) J. Biol. Chem. 266(5):3335-3342); 5-(enolpyruvyl)shikimate-3-phosphate synthase (EPSPS) (Archer et al. (1990) J. Bioenerg. Biomemb. 22(6):789-810); tryptophan synthase (Zhao et al. (1995) J. Biol. Chem. 270(11):6081-6087); plastocyanin (Lawrence et al. (1997) J. Biol. Chem. 272(33):20357-20363); chorismate synthase (Schmidt et al. (1993) J. Biol. Chem. 268(36):27447-27457); and the light harvesting chlorophyll a/b binding protein (LHBP) (Lamppa et al. (1988) J. Biol. Chem. 263: 14996-14999). See also Von Heijne et al. (1991) Plant Mol. Biol. Rep. 9: 104-126; Clark et al. (1989) J. Biol. Chem. 264:17544-17550; Della-Cioppa et al. (1987) Plant Physiol. 84:965-968; Romer et al. (1993) Biochem. Biophys. Res. Commun. 196: 1414-1421; and Shah et al. (1986) Science 233:478-481.

In a preferred embodiment, the transit peptide comprises the amino acid sequence of SEQ ID NO: 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226.

Preferred expression cassettes comprise a transit peptide from *Amaranthus* PPO-2 fused to PPO or PPO like polypeptides, such as chimeric expression cassettes having the SEQ ID NO:240, 241, 242, 243, 244, 245, 246, 247, 248, 249, 250, 251, 252, 253, 254, 255, 256, 257, 258, 259, 260, 261, 262,or 264

Methods for transformation of chloroplasts are known in the art. See, for example, Svab et al. (1990) Proc. Natl. Acad. ScL USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) Proc. Natl. Acad. Sci. USA 91:7301-7305. The nucleic acids of interest to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In a preferred embodiment, the mutated PPO nucleic acid comprises a polynucleotide sequence selected from the group consisting of: a) a polynucleotide encoding a polypeptide as shown in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637,or a variant or derivative thereof; b) a polynucleotide comprising at least 60 consecutive nucleotides of any of a); and c) a polynucleotide complementary to the polynucleotide of any of a) through b)

Preferably, the expression cassette of the present invention further comprises a transcription initiation regulatory region and a translation initiation regulatory region that are functional in the plant.

While the polynucleotides of the invention find use as selectable marker genes for plant transformation, the expression cassettes of the invention can include another selectable marker gene for the selection of transformed cells. Selectable marker genes, including those of the present invention, are utilized for the selection of transformed cells or tissues. Marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). See generally, Yarranton (1992) Curr. Opin. Biotech. 3: 506-511; Christophers on et al (1992) Proc. Natl. Acad. ScL USA 89:6314-6318; Yao et al. (1992) Cell 71:63-72; Reznikoff (1992) Mol Microbiol 6:2419-2422; Barkley et al (1980) in The Operon, pp. 177-220; Hu et al (1987) Cell 48:555-566; Brown et al (1987) Cell 49:603-612; Figge et al (1988) Cell 52:713-722; Deuschle et al (1989) Proc. Natl Acad. AcL USA 86:5400-5404; Fuerst et al (1989) Proc. Natl Acad. ScL USA 86:2549-2553; Deuschle et al (1990) Science 248:480-483; Gossen (1993) Ph.D. Thesis, University of Heidelberg; Reines et al (1993) Proc. Natl Acad. ScL USA 90: 1917-1921; Labow et al (1990) Mol Cell Biol 10:3343-3356; Zambretti et al (1992) Proc. Natl Acad. ScL USA 89:3952-3956; Bairn et al (1991) Proc. Natl Acad. ScL USA 88:5072-5076; Wyborski et al (1991) Nucleic Acids Res. 19:4647-4653; Hillenand-Wissman (1989) Topics Mol Struc. Biol 10: 143-162; Degenkolb et al (1991) Antimicrob. Agents Chemother. 35: 1591-1595; Kleinschnidt et al (1988) Biochemistry 27: 1094-1104; Bonin (1993) Ph.D. Thesis, University of Heidelberg; Gossen et al (1992) Proc. Natl Acad. ScL USA 89:5547-5551; Oliva et al (1992) Antimicrob. Agents Chemother. 36:913-919; Hlavka et al (1985) Handbook of Experimental Pharmacology, Vol. 78 (Springer-Verlag, Berlin); Gill et al (1988) Nature 334:721-724. Such disclosures are herein incorporated by reference. The above list of selectable marker genes is not meant to be limiting. Any selectable marker gene can be used in the present invention.

The invention further provides an isolated recombinant expression vector comprising the expression cassette containing a mutated PPO nucleic acid as described above, wherein expression of the vector in a host cell results in increased tolerance to a uracilpyridine herbicide as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., mutated PPO polypeptides, fusion polypeptides, etc.).

In a preferred embodiment of the present invention, the mutated PPO polypeptides are expressed in plants and plants cells such as unicellular plant cells (such as algae) (See Falciatore et al., 1999, Marine Biotechnology 1(3):239-251 and references therein) and plant cells from higher plants (e.g., the spermatophytes, such as crop plants). A mutated PPO polynucleotide may be "introduced" into a plant cell by any means, including transfection, transformation or transduction, electroporation, particle bombardment, agroinfection, biolistics, and the like.

Suitable methods for transforming or transfecting host cells including plant cells can be found in Sambrook et al. (Molecular Cloning: A Laboratory Manual. 2nd, ed., Cold Spring Harbor Laboratory, Cold Spring Harbor Laboratory Press, Cold Spring Harbor, N.Y., 1989) and other laboratory manuals such as Methods in Molecular Biology, 1995, Vol. 44, Agrobacterium protocols, ed: Gartland and Davey, Humana Press, Totowa, N.J. As increased tolerance to uracilpyridine herbicides is a general trait wished to be inherited into a wide variety of plants like maize, wheat, rye, oat, triticale, rice, barley, soybean, peanut, cotton, rapeseed and canola, *manihot*, pepper, sunflower and *tagetes*, solanaceous plants like potato, tobacco, eggplant, and tomato, *Vicia* species, pea, alfalfa, bushy plants (coffee, cacao, tea), *Salix* species, trees (oil palm, coconut), perennial grasses, and forage crops, these crop plants are also preferred target plants for a genetic engineering as one further embodiment of the present invention. In a preferred embodiment, the plant is a crop plant. Forage crops include, but are not limited to, Wheatgrass, Canarygrass, Bromegrass, Wildrye Grass, Bluegrass, Orchardgrass, Alfalfa, Salfoin, Birdsfoot Trefoil, Alsike Clover, Red Clover, and Sweet Clover.

In one embodiment of the present invention, transfection of a mutated PPO polynucleotide into a plant is achieved by *Agrobacterium* mediated gene transfer. One transformation method known to those of skill in the art is the dipping of a flowering plant into an Agrobacteria solution, wherein the Agrobacteria contains the mutated PPO nucleic acid, followed by breeding of the transformed gametes. *Agrobacterium* mediated plant transformation can be performed using for example the GV3101(pMP90) (Koncz and Schell, 1986, Mol. Gen. Genet. 204:383-396) or LBA4404 (Clontech) *Agrobacterium tumefaciens* strain. Transformation can be performed by standard transformation and regeneration techniques (Deblaere et al., 1994, Nucl. Acids. Res. 13:4777-4788; Gelvin, Stanton B. and Schilperoort, Robert A, Plant Molecular Biology Manual, 2nd Ed.—Dordrecht: Kluwer Academic Publ., 1995.— in Sect., Ringbuc Zentrale Signatur: BT11-P ISBN 0-7923-2731-4; Glick, Bernard R. and Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant Cell Report 8:238-242; De Block et al., 1989, Plant Physiol. 91:694-701). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543, or U.S. Pat. No. 5,169,770. Transformation of maize can be achieved by particle bombardment, polyethylene glycol mediated DNA uptake, or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced mutated PPO polynucleotide may be maintained in the plant cell stably if it is incorporated into a non-chromosomal autonomous replicon or integrated into the plant chromosomes. Alternatively, the introduced mutated PPO polynucleotide may be present on an extra-chromosomal non-replicating vector and be transiently expressed or transiently active. In one embodiment, a homologous recombinant microorganism can be created wherein the mutated PPO polynucleotide is integrated into a chromosome, a vector is prepared which contains at least a portion of an PPO gene into which a deletion, addition, or substitution has been introduced to thereby alter, e.g., functionally disrupt, the endogenous PPO gene and to create a mutated PPO gene. To create a point mutation via homologous recombination, DNA-RNA hybrids can be used in a technique known as chimeraplasty (Cole-Strauss et al., 1999, Nucleic Acids Research 27(5):1323-1330 and Kmiec, 1999, Gene therapy American Scientist 87(3):240-247). Other homologous recombination procedures in *Triticum* species are also well known in the art and are contemplated for use herein.

In the homologous recombination vector, the mutated PPO gene can be flanked at its 5' and 3' ends by an additional nucleic acid molecule of the PPO gene to allow for homologous recombination to occur between the exogenous mutated PPO gene carried by the vector and an endogenous PPO gene, in a microorganism or plant. The additional flanking PPO nucleic acid molecule is of sufficient length for successful homologous recombination with the endogenous gene. Typically, several hundreds of base pairs up to kilobases of flanking DNA (both at the 5' and 3' ends) are included in the vector (see e.g., Thomas, K. R., and Capecchi, M. R., 1987, Cell 51:503 for a description of homologous recombination vectors or Strepp et al., 1998, PNAS, 95(8):4368-4373 for cDNA based recombination in *Physcomitrella patens*). However, since the mutated PPO gene normally differs from the PPO gene at very few amino acids, a flanking sequence is not always necessary. The homologous recombination vector is introduced into a microorganism or plant cell (e.g., via polyethylene glycol mediated DNA), and cells in which the introduced mutated PPO gene has homologously recombined with the endogenous PPO gene are selected using art-known techniques.

In another embodiment, recombinant microorganisms can be produced that contain selected systems that allow for regulated expression of the introduced gene. For example, inclusion of a mutated PPO gene on a vector placing it under control of the lac operon permits expression of the mutated PPO gene only in the presence of IPTG. Such regulatory systems are well known in the art.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, a mutated PPO polynucleotide can be expressed in bacterial cells such as *C. glutamicum*, insect cells, fungal cells, or mammalian cells (such as Chinese hamster ovary cells (CHO) or COS cells), algae, ciliates, plant cells, fungi or other microorganisms like *C. glutamicum*. Other suitable host cells are known to those skilled in the art.

A host cell of the invention, such as a prokaryotic or eukaryotic host cell in culture, can be used to produce (i.e., express) a mutated PPO polynucleotide. Accordingly, the invention further provides methods for producing mutated PPO polypeptides using the host cells of the invention. In one embodiment, the method comprises culturing the host cell of invention (into which a recombinant expression vector encoding a mutated PPO polypeptide has been introduced, or into which genome has been introduced a gene encoding a wild-type or mutated PPO polypeptide) in a suitable medium until mutated PPO polypeptide is produced. In another embodiment, the method further comprises isolating mutated PPO polypeptides from the medium or the host cell. Another aspect of the invention pertains to isolated mutated PPO polypeptides, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of mutated PPO polypeptide in which the polypeptide is separated from some of the cellular components of the cells in which it is naturally or recombinantly produced. In one embodiment, the language "substantially free of cellular material" includes preparations of a mutated PPO polypeptide having less than about 30% (by dry weight) of non-mutated PPO material (also referred to herein as a "contaminating polypeptide"), more preferably less than about 20% of non-mutated PPO material, still more preferably less than about 10% of non-mutated PPO material, and most preferably less than about 5% non-mutated PPO material.

When the mutated PPO polypeptide, or biologically active portion thereof, is recombinantly produced, it is also preferably substantially free of culture medium, i.e., culture medium represents less than about 20%, more preferably less than about 10%, and most preferably less than about 5% of the volume of the polypeptide preparation. The language "substantially free of chemical precursors or other chemicals" includes preparations of mutated PPO polypeptide in which the polypeptide is separated from chemical precursors or other chemicals that are involved in the synthesis of the polypeptide. In one embodiment, the language "substantially free of chemical precursors or other chemicals" includes preparations of a mutated PPO polypeptide having less than about 30% (by dry weight) of chemical precursors or non-mutated PPO chemicals, more preferably less than about 20% chemical precursors or non-mutated PPO chemicals, still more preferably less than about 10% chemical precursors or non-mutated PPO chemicals, and most preferably less than about 5% chemical precursors or non-mutated PPO chemicals. In preferred embodiments, isolated polypeptides, or biologically active portions thereof, lack contaminating polypeptides from the same organism from which the mutated PPO polypeptide is derived. Typically, such polypeptides are produced by recombinant expression of, for example, a mutated PPO polypeptide in plants other than, or in microorganisms such as *C. glutamicum*, ciliates, algae, or fungi.

In other aspects, a method for treating a plant of the present invention is provided.

In some embodiments, the method comprises contacting the plant with an agronomically acceptable composition.

In another aspect, the present invention provides a method for preparing a descendent seed. The method comprises planting a seed of or capable of producing a plant of the present invention. In one embodiment, the method further comprises growing a descendent plant from the seed; and harvesting a descendant seed from the descendent plant. In other embodiments, the method further comprises applying a uracilpyridine herbicides herbicidal composition to the descendent plant.

In another embodiment, the invention refers to harvestable parts of the transgenic plant according to the present invention. Preferably, the harvestable parts comprise the PPO nucleic acid or PPO protein of the present invention. The harvestable parts may be seeds, roots, leaves and/or flowers comprising the PPO nucleic acid or PPO protein or parts thereof. Preferred parts of soy plants are soy beans comprising the PPO nucleic acid or PPO protein.

In another embodiment, the invention refers to products derived from a plant according to the present invention, parts thereof or harvestable parts thereof. A preferred plant product is fodder, seed meal, oil, or seed-treatment-coated seeds. Preferably, the meal and/or oil comprises the mutated PPO nucleic acids or PPO proteins of the present invention.

In another embodiment, the invention refers to a method for the production of a product, which method comprises
  a) growing the plants of the invention or obtainable by the methods of invention and
  b) producing said product from or by the plants of the invention and/or parts, e.g. seeds, of these plants.

In a further embodiment the method comprises the steps
  a) growing the plants of the invention,
  b) removing the harvestable parts as defined above from the plants and
  c) producing said product from or by the harvestable parts of the invention.

The product may be produced at the site where the plant has been grown, the plants and/or parts thereof may be removed from the site where the plants have been grown to produce the product. Typically, the plant is grown, the desired harvestable parts are removed from the plant, if feasible in repeated cycles, and the product made from the harvestable parts of the plant. The step of growing the plant may be performed only once each time the methods of the invention is performed, while allowing repeated times the steps of product production e.g. by repeated removal of harvestable parts of the plants of the invention and if necessary further processing of these parts to arrive at the product. It is also possible that the step of growing the plants of the invention is repeated and plants or harvestable parts are stored until the production of the product is then performed once for the accumulated plants or plant parts. Also, the steps of growing the plants and producing the product may be performed with an overlap in time, even simultaneously to a large extend or sequentially. Generally the plants are grown for some time before the product is produced.

In one embodiment the products produced by said methods of the invention are plant products such as, but not limited to, a foodstuff, feedstuff, a food supplement, feed supplement, fiber, cosmetic and/or pharmaceutical Foodstuffs are regarded as compositions used for nutrition and/or for supplementing nutrition. Animal feedstuffs and animal feed supplements, in particular, are regarded as foodstuffs.

In another embodiment the inventive methods for the production are used to make agricultural products such as, but not limited to, plant extracts, proteins, amino acids, carbohydrates, fats, oils, polymers, vitamins, and the like.

It is possible that a plant product consists of one or more agricultural products to a large extent.

As described above, the present invention teaches compositions and methods for increasing the PPO-inhibiting tolerance of a crop plant or seed as compared to a wild-type variety of the plant or seed. In a preferred embodiment, the PPO-inhibiting tolerance of a crop plant or seed is increased such that the plant or seed can withstand a uracilpyridine herbicide application of preferably approximately 1-1000 g ai ha$^{-1}$, more preferably 1-200 g ai ha$^{-1}$, even more preferably 5-150 g ai ha$^{-1}$, and most preferably 10-100 g ai ha$^{-1}$. As used herein, to "withstand" a uracilpyridine herbicide application means that the plant is either not killed or only moderately injured by such application. It will be understood by the person skilled in the art that the application rates may vary, depending on the environmental conditions such as temperature or humidity, and depending on the chosen kind of herbicide (active ingredient ai).

Furthermore, the present invention provides methods that involve the use of at least one uracilpyridine herbicide, optionally in combination with one or more herbicidal compounds B, and, optionally, a safener C, as described in detail supra.

In these methods, the uracilpyridine herbicide can be applied by any method known in the art including, but not limited to, seed treatment, soil treatment, and foliar treatment. Prior to application, the uracilpyridine herbicide can be converted into the customary formulations, for example solutions, emulsions, suspensions, dusts, powders, pastes and granules. The use form depends on the particular intended purpose; in each case, it should ensure a fine and even distribution of the compound according to the invention.

By providing plants having increased tolerance to uracilpyridine herbicide, a wide variety of formulations can be employed for protecting plants from weeds, so as to enhance plant growth and reduce competition for nutrients. A uracilpyridine herbicide can be used by itself for pre-emergence, post-emergence, pre-planting, and at-planting control of weeds in areas surrounding the crop plants described herein, or a uracilpyridine herbicide formulation can be used that contains other additives. The uracilpyridine herbicide can also be used as a seed treatment. Additives found in a uracilpyridine herbicide formulation include other herbicides, detergents, adjuvants, spreading agents, sticking agents, stabilizing agents, or the like. The uracilpyridine herbicide formulation can be a wet or dry preparation and can include, but is not limited to, flowable powders, emulsifiable concentrates, and liquid concentrates. The uracilpyridine herbicide and herbicide formulations can be applied in accordance with conventional methods, for example, by spraying, irrigation, dusting, or the like.

Suitable formulations are described in detail in PCT/EP2009/063387 and PCT/EP2009/063386, which are incorporated herein by reference.

It should also be understood that the foregoing relates to preferred embodiments of the present invention and that numerous changes may be made therein without departing from the scope of the invention. The invention is further illustrated by the following examples, which are not to be construed in any way as imposing limitations upon the scope thereof.

On the contrary, it is to be clearly understood that resort may be had to various other embodiments, modifications, and equivalents thereof, which, after reading the description herein, may suggest themselves to those skilled in the art without departing from the spirit of the present invention and/or the scope of the appended claims.

EXAMPLES

| | |
|---|---|
| Uracilpyridine 1 | ethyl 2-[[3-[2-chloro-4-fluoro-5-[3-methyl-2,6-dioxo-4-(trifluoromethyl)pyrimidin-1-yl]phenoxy]-2-pyridyl]oxy]acetate |
| Uracilpyridine 2 | ethyl 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 3 | 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetic acid |
| Uracilpyridine 4 | ethyl 2-[2-[[3-chloro-5-fluoro-6-[3-methyl-2,6-dioxo-4-(trifluoromethyl)pyrimidin-1-yl]-2-pyridyl]oxy]phenoxy]acetate |
| Uracilpyridine 5 | 2-[2-[[3-chloro-5-fluoro-6-[3-methyl-2,6-dioxo-4-(trifluoromethyl)pyrimidin-1-yl]-2-pyridyl]oxy]phenoxy]acetic acid |
| Uracilpyridine 6 | ethyl 2-[2-[[3-bromo-6-[3-methyl-2,6-dioxo-4-(trifluoromethyl)pyrimidin-1-yl]-2-pyridyl]oxy]phenoxy]acetate |
| Uracilpyridine 7 | ethyl 2-[2-[[3-chloro-5-fluoro-6-[3-methyl-2,6-dioxo-4-(trifluoromethyl)pyrimidin-1-yl]-2-pyridyl]oxy]-4-fluoro-phenoxy]acetate |
| Uracilpyridine 8 | ethyl 2-[2-[[3,5-difluoro-6-[3-methyl-2,6-dioxo-4-(trifluoromethyl)pyrimidin-1-yl]-2-pyridyl]oxy]phenoxy]acetate |
| Uracilpyridine 9 | 2-[2-[[3,5-difluoro-6-[3-methyl-2,6-dioxo-4-(trifluoromethyl)pyrimidin-1-yl]-2-pyridyl]oxy]phenoxy]acetic acid |
| Uracilpyridine 10 | 2-[2-[[3-chloro-5-fluoro-6-[3-methyl-2,6-dioxo-4-(trifluoromethyl)pyrimidin-1-yl]-2-pyridyl]oxy]phenoxy]-N-methylsulfonyl-acetamide |
| Uracilpyridine 11 | ethyl 2-[[3-[[3-chloro-6-[3,5-dimethyl-2,6-dioxo-4-(trifluoromethyl)pyrimidin-1-yl]-5-fluoro-2-pyridyl]oxy]-2-pyridyl]oxy]acetate |
| Uracilpyridine 12 | ethyl 2-[2-[[3-chloro-6-[3,5-dimethyl-2,6-dioxo-4-(trifluoromethyl)pyrimidin-1-yl]-5-fluoro-2-pyridyl]oxy]phenoxy]acetate |
| Uracilpyridine 13 | allyl 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 14 | prop-2-ynyl 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 15 | cyclopropylmethyl 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 16 | 2,2-difluoroethyl 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 17 | isobutyl 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 18 | (2-ethoxy-2-oxo-ethyl) 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 19 | 2-methoxyethyl 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]acetate |
| Uracilpyridine 20 | 2-[[3-[[3-chloro-5-fluoro-6-[3-methyl-2,6-dioxo-4-(trifluoromethyl)pyrimidin-1-yl]-2-pyridyl]oxy]-2-pyridyl]oxy]-N-methylsulfonyl-acetamide |
| Uracilpyridine 21 | methyl 2-[2-[[3-chloro-5-fluoro-6-[3-methyl-2,6-dioxo-4-(trifluoromethyl)pyrimidin-1-yl]-2-pyridyl]oxy]phenoxy]acetate |
| Uracilpyridine 22 | ethyl 2-[2-[[3-bromo-5-fluoro-6-[3-methyl-2,6-dioxo-4-(trifluoromethyl)pyrimidin-1-yl]-2-pyridyl]oxy]phenoxy]acetate |

Example 1: Site-Directed Mutagenesis PPO

All nucleic acid coding sequence and all single and double mutants encoding a herbicide tolerant PPO polypeptides are synthesized and cloned by Geneart (Geneart AG, Regensburg, Germany). Rational design mutants are synthesized by Geneart. Random PPO gene libraries are synthesized by Geneart. Plasmids are isolated from E. coli TOP10 by performing a plasmid minpreparation and confirmed by DNA sequencing.

Example 2: Expression and Purification of Recombinant Wildtype and Mutant PPO (Taken from: Franck E. Dayan, Pankaj R. Daga, Stephen O. Duke, Ryan M. Lee, Patrick J. Tranel, Robert J. Doerksen. Biochemical and structural consequences of aglycine deletion in the α-8 helix of protoporphyrinogen oxidase. Biochimica et Biophysica Acta 1804 (2010), 1548-56) Clones in pRSET vector are transformed into BL21(DE3)-pLysS strain of E. coli. Cells are grown in 250 mL of LB with 100 μgmL-1 of carbenicillin, shaking overnight at 37° C. Cultures are diluted in 1 L of LB with antibiotic and grown at 37° C. shaking for 2 h, induced with 1 mM IPTG and grown at 25° C. shaking for 5 more hours. The cells are harvested by centrifugation at 1600×g, washed with 0.09% NaCl, and stored at −80° C. Cells are lysed using a French press at 140 MPa in 50 mM sodium phosphate pH 7.5, 1 M NaCl, 5 mM imidazole, 5% glycerol, and 1 μg mL-1 leupeptin. Following lysis, 0.5 U of benzonase (Novagen, EMD Chemicals, Inc., Gibbstown, N.J.) and PMSF (final concentration of 1 mM) are added. Cell debris is removed by centrifugation at 3000×g. His-tagged PPO proteins are purified on a nickel activated Hitrap Chelating HP column (GE Healthcare Bio-Sciences Corp., Piscataway, N.J.) equilibrated with 20 mM sodium phosphate pH 8.0, 50 mM NaCl, 5 mM imidazole, 5 mM MgCl2, 0.1 mM EDTA, and 17% glycerol. PPO is eluted with 250 mM imidazole. The active protein is desalted on a PD-10 column (GE Healthcare Bio-Sciences Corp., Piscataway, N.J.) equilibrated with a 20 mM sodium phosphate buffer, pH 7.5, 5 mM MgCl2, 1 mM EDTA and 17% glycerol. Each litre of culture provided approximately 10 mg of pure PPO, which is stored at −20° C. until being used in assays.

Example 3: PPO Enzyme Assay (Non-Recombinant)

PPO protein (EC 1.3.3.4) is extracted from coleoptiles or shoots (150 g fresh weight) of dark-grown corn, black nightshade, morning glory, and velvetleaf seedlings as described previously (Grossmann et al. 2010). Before harvesting, the seedlings are allowed to green for 2 hours in the light in order to achieve the highest specific enzyme activities in the thylakoid fractions at low chlorophyll concentrations. At high chlorophyll concentrations significant quenching of fluorescence occurs, which limits the amount of green thylakoids that can be used in the test. Plant materials are homogenized in the cold with a Braun blender using a fresh-weight-to-volume ratio of 1:4. Homogenization buffer consisted of tris(hydroxymethyl)aminomethane (Tris)-HCl (50 mM; pH 7.3), sucrose (0.5 M), magnesium chloride (1 mM), ethylenediaminetetraacetic acid (EDTA) (1 mM) and bovine serum albumin (2 g L$^{-1}$). After filtration through four layers of Miracloth, crude plastid preparations are obtained after centrifugation at 10 000×g for 5 min and resuspension in homogenization buffer before centrifugation at 150×g for 2 min to remove crude cell debris. The supernatant is centrifuged at 4000×g for 15 min and the pellet fraction is resuspended in 1 ml of a buffer containing Tris-HCl (50 mM; pH 7.3), EDTA (2 mM), leupeptin (2 μM), pepstatin (2 μM) and glycerol (200 ml L$^{-1}$) and stored at −80° C. until use. Protein is determined in the enzyme extract with bovine serum albumin as a standard. PPO activity is assayed fluorometrically by monitoring the rate of Proto formation from chemically reduced protoporphyrinogen IX under initial velocity conditions. The assay mixture consisted of Tris-HCl (100 mM; pH 7.3), EDTA (1 mM), dithiothreitol (5 mM), Tween 80 (0.085%), protoporphyrinogen IX (2 μM), and 40 μg extracted protein in a total volume of 200 μl. The reaction is initiated by addition of substrate protoporphyrinogen IX at 22° C. The uracilpyridines disclosed SUPRA, and photosynthesis inhibitor diuron as negative control are prepared in dimethyl sulfoxide (DMSO) solution (0.1 mM concentration of DMSO in the assay) and added to the assay mixture in concentrations of 0.005 μM to 5 μM before incubation. Fluorescence is monitored directly from the assay mixture using a POLARstar Optima/Galaxy (BMG) with excitation at 405 nm and emission monitored at 630 nm. Non-enzymatic activity in the presence of heat-inactivated extract is negligible. Inhibition of enzyme activity induced by the herbicide is expressed as percentage inhibition relative to untreated controls. Molar concentrations of compound required for 50% enzyme inhibition (IC$_{50}$ values) are calculated by fitting the values to the dose-response equation using non-linear regression analysis.

Example 4: PPO Enzyme Assay (Recombinant)

Proto is purchased from Sigma-Aldrich (Milwaukee, Wis.). Protogen is prepared according to Jacobs and Jacobs (N.J. Jacobs, J. M. Jacobs, Assay for enzymatic protoporphyrinogen oxidation, a late step in heme synthesis, Enzyme 28 (1982) 206-219). Assays are conducted in 100 mM sodium phosphate pH 7.4 with 0.1 mM EDTA, 0.1% Tween 20, 5 μM FAD, and 500 mM imidazole. Dose-response curves with the uracilpyridines disclosed SUPRA, and photosynthesis inhibitor diuron as negative control, and MC-15608 are obtained in the presence of 150 μM Protogen. The excitation and emission bandwidths are set at 1.5 and 30 nm, respectively. All assays are made in duplicates or triplicates and measured using a POLARstar Optima/Galaxy (BMG) with excitation at 405 nm and emission monitored at 630 nm. Molar concentrations of compound required for 50% enzyme inhibition (IC$_{50}$ values) are calculated by fitting the values to the dose-response equation using non-linear regression analysis. The results are shown in Table x.

TABLE x

| Compound | Variant PPO Enzyme and IC50 (M) Based on SEQ ID NO: 1 (Amaranthus PPO2) | | Wild Type PPO Enzyme IC50 (M) | Tolerance Factor (R/S) |
| --- | --- | --- | --- | --- |
| Uracilpyridine 1 | R128A, F420V | 2.80E−07 | 1.77E−10 | 1579 |
| Uracilpyridine 1 | R128A, F420V | 1.62E−07 | 1.77E−10 | 915 |
| Uracilpyridine 1 | R128A, F420M | 6.16E−08 | 1.77E−10 | 347 |
| Uracilpyridine 1 | L397Q, F420V | 2.26E−06 | 1.77E−10 | 12739 |
| Uracilpyridine 1 | L397Q, F420M | 4.29E−07 | 1.77E−10 | 2418 |

TABLE x-continued

| Compound | Variant PPO Enzyme and IC50 (M) Based on SEQ ID NO: 1 (Amaranthus PPO2) | | Wild Type PPO Enzyme IC50 (M) | Tolerance Factor (R/S) |
|---|---|---|---|---|
| Uracilpyridine 1 | L397Q | 2.38E−09 | 1.77E−10 | 13 |
| Uracilpyridine 1 | F420V | 6.64E−08 | 1.77E−10 | 374 |
| Uracilpyridine 1 | F420M | 3.81E−08 | 1.77E−10 | 215 |
| Uracilpyridine 1 | F420M | 4.69E−08 | 1.77E−10 | 265 |
| Uracilpyridine 4 | R128A, F420V | 2.97E−07 | 1.73E−10 | 1718 |
| Uracilpyridine 4 | R128A, F420M | 6.94E−08 | 1.73E−10 | 401 |
| Uracilpyridine 4 | F420M | 9.44E−09 | 1.73E−10 | 55 |
| Uracilpyridine 2 | R128A, F420V | 1.49E−07 | 1.87E−10 | 796 |
| Uracilpyridine 2 | R128A, F420V | 2.07E−07 | 1.87E−10 | 1105 |
| Uracilpyridine 2 | R128A, F420M | 9.74E−08 | 1.87E−10 | 521 |
| Uracilpyridine 2 | L397Q, F420V | 2.56E−06 | 1.87E−10 | 13678 |
| Uracilpyridine 2 | L397Q, F420M | 9.05E−07 | 1.87E−10 | 4843 |
| Uracilpyridine 2 | L397Q | 1.29E−09 | 1.87E−10 | 7 |
| Uracilpyridine 2 | F420V | 1.06E−07 | 1.87E−10 | 567 |
| Uracilpyridine 2 | F420M | 4.57E−08 | 1.87E−10 | 244 |
| Uracilpyridine 2 | F420M | 7.76E−08 | 1.87E−10 | 415 |
| Uracilpyridine 8 | R128A, F420V | 2.25E−06 | 4.96E−10 | 4531 |
| Uracilpyridine 8 | F420M | 6.91E−08 | 4.96E−10 | 139 |
| Uracilpyridine 10 | R128A, F420M | 1.67E−06 | 2.12E−10 | 7879 |
| Uracilpyridine 10 | L397E, F420M | 6.51E−06 | 2.12E−10 | 30714 |
| Uracilpyridine 12 | R128A, F420M | 1.14E−07 | 2.12E−10 | 536 |
| Uracilpyridine 13 | R128A, F420M | 9.18E−08 | 2.18E−10 | 421 |
| Uracilpyridine 14 | R128A, F420M | 1.58E−07 | 2.34E−10 | 675 |
| Uracilpyridine 19 | R128A, F420M | 1.25E−07 | 2.48E−10 | 503 |
| Uracilpyridine 15 | R128A, F420M | 4.29E−08 | 2.20E−10 | 195 |
| Uracilpyridine 16 | R128A, F420M | 8.90E−08 | 1.75E−10 | 508 |
| Uracilpyridine 17 | R128A, F420M | 4.61E−08 | 1.13E−10 | 406 |
| Uracilpyridine 18 | R128A, F420M | 1.16E−07 | 1.54E−10 | 753 |

Example 5: Engineering PPO-Derivative Herbicide Tolerant Plants Having Wildtype or Mutated PPO Sequences PPO-derivative herbicide tolerant soybean (*Glyceine max*), plants are produced by a method as described by Olhoft et al. (US patent 2009/0049567). For transformation of soybean or *Arabidopsis thaliana*, Wildtype or Mutated PPO sequences encoding herbicide tolerant PPO polypeptides are cloned with standard cloning techniques as described in Sambrook eta. (Molecular cloning (2001) Cold Spring Harbor Laboratory Press) in a binary vector containing resistance marker gene cassette (AHAS) and mutated PPO sequence (marked as GOI) in between ubiquitin promoter (PcUbi) and nopaline synthase terminator (NOS) sequence. For corn transformation, Wildtype or Mutated PPO sequences are cloned with standard cloning techniques as described in Sambrook et a. (Molecular cloning (2001) Cold Spring Harbor Laboratory Press) in a binary vector containing resistance marker gene cassette (AHAS) and mutated PPO sequence (marked as GOI) in between corn ubiquitin promoter (ZmUbi) and nopaline synthase terminator (NOS) sequence. Binary plasmids are introduced to *Agrobacterium tumefaciens* for plant transformation. Plasmid constructs are introduced into soybean's axillary meristem cells at the primary node of seedling explants via *Agrobacterium*-mediated transformation. After inoculation and co-cultivation with Agrobacteria, the explants are transferred to shoot introduction media without selection for one week. The explants are subsequently transferred to a shoot induction medium with 1-3 µM imazapyr (Arsenal) for 3 weeks to select for transformed cells. Explants with healthy callus/shoot pads at the primary node are then transferred to shoot elongation medium containing 1-3 µM imazapyr until a shoot elongated or the explant died. Transgenic plantlets are rooted, subjected to TaqMan analysis for the presence of the transgene, transferred to soil and grown to maturity in greenhouse. Plant transformation vector constructs containing mutated PPO sequences are introduced into maize immature embryos via *Agrobacterium*-mediated transformation according to the procedure outlined in Peng et al. (WO2006/136596).

Transformed cells are selected in selection media supplemented with 0.5-1.5 µM imazethapyr for 3-4 weeks. Transgenic plantlets are regenerated on plant regeneration media and rooted afterwards. Transgenic plantlets are subjected to TaqMan analysis for the presence of the transgene before being transplanted to potting mixture and grown to maturity in greenhouse. *Arabidopsis thaliana* are transformed with wildtype or mutated PPO sequences by floral dip method as described by McElver and Singh (WO 2008/124495). Transgenic *Arabidopsis* plants are subjected to TaqMan analysis for analysis of the number of integration loci. Transformation of *Oryza sativa*(rice) are done by protoplast transformation as described by Peng et a. (U.S. Pat. No. 6,653,529) T0 or T1 transgenic plants of soybean, corn, and rice containing mutated PPO sequences are tested for improved tolerance to PPO-derived herbicides in greenhouse studies and mini-plot studies with the uracilpyridines disclosed SUPRA, and photosynthesis inhibitor diuron as negative control.

Example 6: Tissue Culture Conditions

An in vitro tissue culture mutagenesis assay has been developed to isolate and characterize plant tissue (e.g., maize, rice tissue) that is tolerant to protoporphyrinogen oxidase inhibiting herbicides, e.g. the uracilpyridines disclosed SUPRA, and photosynthesis inhibitor diuron as negative control). The assay utilizes the somaclonal variation that is found in in vitro tissue culture. Spontaneous mutations derived from somaclonal variation can be enhanced by treatment with a chemical mutagen (e.g. Ethyl methanesulfonate, N-ethyl-N-nitrosourea, N-Nitroso-N-methylurea) and subsequent selection in a stepwise manner, on increasing concentrations of herbicide.

The present invention provides tissue culture conditions for encouraging growth of friable, embryogenic maize or rice callus that is regenerable. Calli are initiated from rice cultivar Indica (Indica I). Seeds are surface sterilized in 70% ethanol for approximately 1 min followed by 20% commercial Clorox bleach for 20 minutes. Seeds are rinsed with sterile water and plated on R001 M media. The ingredient lists for the media tested are presented in Table y.

TABLE y

| Ingredients | Supplier | R001M | R025M | R026M | R327M | R008S |
|---|---|---|---|---|---|---|
| N6 Salts | Phytotech | 4 g/L | 4 g/L | 4.3 g/L | 4.3 g/L | 3.25 g/L |
| N6 vitamins | Phytotech | 1X | 1X | 1X | 1X | |
| Maltose | VWR | 30 g/L | 30 g/L | 30 g/L | 30 g/L | |
| Casamino Acid | BD | 0.3 g/L | 0.3 g/L | 2 g/L | | |
| Proline | Sigma | 2.9 g/L | 0.5 g/L | | | |
| 2,4-D | ICN | 2 mg/L | | | | |
| MES | Sigma | 0.5 g/L | 0.5 g/L | 0.5 g/L | 0.5 g/L | 0.5 g/L |
| MS Salts | Phytotech | | | | | |
| MS Vitamins | Phytotech | | | | | |
| Sorbitol | Sigma | | | 30 g/L | | |
| Sucrose | Sigma | | | | | 20 g/L |
| Nicotinic Acid | Sigma | | | | | 0.5 mg/L |
| Pyridoxine HCL | Sigma | | | | | 0.5 mg/L |
| Thiamine HCL | Sigma | | | | | 1 mg/L |
| Myo-inositol | Sigma | | | | | 0.1 g/L |

R001M callus induction media is selected after testing numerous variations. Cultures are kept in the dark at 30° C. Embryogenic callus is subcultured to fresh media after 10-14 days.

Example 7: Selection of Herbicide-Tolerant Calli

Once tissue culture conditions are determined, further establishment of selection conditions are established through the analysis of tissue survival in kill curves with saflufenacil, trifludimoxazin, sulfentrazone, and the uracilpyridines disclosed SUPRA, and photosynthesis inhibitor diuron as negative control. Careful consideration of accumulation of the herbicide in the tissue, as well as its persistence and stability in the cells and the culture media is performed. Through these experiments, a sub-lethal dose has been established for the initial selection of mutated material. After the establishment of the starting dose of uracilpyridines disclosed SUPRA, and photosynthesis inhibitor diuron as negative control in selection media, the tissues are selected in a step-wise fashion by increasing the concentration of the PPO inhibitor with each transfer until cells are recovered that grew vigorously in the presence of toxic doses. The resulting calli are further subcultured every 3-4 weeks to R001M with selective agent. Over 26,000 calli are subjected to selection for 4-5 subcultures until the selective pressure is above toxic levels as determined by kill curves and observations of continued culture. Alternatively, liquid cultures initiated from calli in MS711R with slow shaking and weekly subcultures. Once liquid cultures are established, selection agent is added directly to the flask at each subculture. Following 2-4 rounds of liquid selection, cultures are transferred to filters on solid R001M media for further growth.

Example 8: Regeneration of Plants

Tolerant tissue, e.g. rice tissue, is regenerated and characterized molecularly for PPO gene, e.g. *Oryza sative* PPO2 sequence mutations and/or biochemically for altered PPO activity in the presence of the selective agent. In addition, genes involved directly and/or indirectly in tetrapyrrole biosynthesis and/or metabolism pathways are also sequenced to characterize mutations. Finally, enzymes that change the fate (e.g. metabolism, translocation, transportation) are also sequence to characterized mutations. Following herbicide selection, calli are regenerated using a media regime of R025M for 10-14 days, R026M for ca. 2 weeks, R327M until well formed shoots are developed, and R008S until shoots are well rooted for transfer to the greenhouse. Regeneration is carried out in the light. No selection agent is included during regeneration. Once strong roots are established, M0 regenerants are transplant to the greenhouse in square or round pots. Transplants are maintained under a clear plastic cup until they are adapted to greenhouse conditions. The greenhouse is set to a day/night cycle of 27° C./21° C. (80° F./70° F.) with 600 W high pressure sodium lights supplementing light to maintain a 14 hour day length. Plants are watered according to need, depending in the weather and fertilized daily.

Example 9: Sequence Analysis

Leaf tissue is collected from clonal plants separated for transplanting and analyzed as individuals. Genomic DNA is extracted using a Chloropure Nucleic acid extraction kit (Agencourt, U.S. Pat. Nos. 5,898,071; 5,705,628; 6,534,262) as directed by the manufacturer. Isolated DNA is PCR amplified using the appropriate forward and reverse primer. PCR amplification is performed using LongAmp HotStart Taq DNA Polymerase Mix (New England Biolabs) using thermocycling program as follows: 94° C. for 30 sec, followed by 35 cycles (94° C., 30 sec; 54° C., 30 sec; 65° C., 300 sec), 10 min at 65° C.

PCR products are verified for concentration and fragment size via agarose gel electrophoresis. Dephosphorylated PCR products are analyzed by direct sequence using the PCR primers (Genewiz or GenScript). Chromatogram trace files (.scf) are analyzed for mutation relative to the wild-type gene using Sequencher (Gene Codes) or Vector NTI Advance 10™ (Invitrogen). Based on sequence information, mutations are identified in several individuals. Sequence analysis is performed on the representative chromatograms and corresponding alignment with default settings and edited to call secondary peaks.

Example 10: Demonstration of Herbicide-Tolerance

T0 or T1 transgenic plant of soybean, corn, Canola varieties and rice containing PPO1 and or PPO2 sequences are tested for improved tolerance to herbicides in greenhouse studies and mini-plot studies with the uracilpyridines disclosed SUPRA, and photosynthesis inhibitor diuron as negative control. For the pre-emergence treatment, the herbicides are applied directly after sowing by means of finely distributing nozzles. The containers are irrigated gently to promote germination and growth and subsequently covered with transparent plastic hoods until the plants have rooted. This cover causes uniform germination of the test plants, unless this has been impaired by the herbicides. For post emergence treatment, the test plants are first grown to a height of 3 to 15 cm, depending on the plant habit, and only then treated with the herbicides. For this purpose, the test plants are either sown directly, and grown in the same containers or they are first grown separately and transplanted into the test containers a few days prior to treatment.

For testing of T0 plants, cuttings can be used. In the case of soybean plants, an optimal shoot for cutting is about 7.5 to 10 cm tall, with at least two nodes present. Each cutting is taken from the original transformant (mother plant) and dipped into rooting hormone powder (indole-3-butyric acid, IBA). The cutting is then placed in oasis wedges inside a bio-dome. Wild type cuttings are also taken simultaneously to serve as controls. The cuttings are kept in the bio-dome for 5-7 days and then transplanted to pots and then acclimated in the growth chamber for two more days. Subsequently, the cuttings are transferred to the greenhouse, acclimated for approximately 4 days, and then subjected to spray tests as indicated. Depending on the species, the plants are kept at 10-25° C. or 20-35° C. The test period extends over 3 weeks. During this time, the plants are tended and their response to the individual treatments is evaluated. Herbicide injury evaluations are taken at 2 and 3 weeks after treatment. Plant injury is rated on a scale of 0% to 100%, 0% being no injury and 100% being complete death.

Transgenic *Arabidopsis thaliana* plants are assayed for improved tolerance to the uracilpyridines disclosed SUPRA, in 48-well plates. Therefore, T2 seeds are surface sterilized by stirring for 5 min in ethanol+water (70+30 by volume), rinsing one time with ethanol+water (70+30 by volume) and two times with sterile, deionized water. The seeds are resuspended in 0.1% agar dissolved in water (w/v) Four to five seeds per well are plated on solid nutrient medium consisting of half-strength murashige skoog nutrient solution, pH 5.8 (Murashige and Skoog (1962) *Physiologia Plantarum* 15: 473-497). Compounds are dissolved in dimethylsulfoxid (DMSO) and added to the medium prior solidification (final DMSO concentration 0.1%). Multi well plates are incubated in a growth chamber at 22° C., 75% relative humidity and 110 µmol Phot*$m^{-2}$*$s^{-1}$ with 14: 10 h light: dark photoperiod. Growth inhibition is evaluated seven to ten days after seeding in comparison to wild type plants. The results are shown in Table i)

| Compound | Gene Species Source | Construct Name | Tolerance Factor* |
|---|---|---|---|
| Uracilpyridine 1 | *Amaranthus tuberculatus* | AMATU_PPO2_WT | 6 |
| Uracilpyridine 1 | *Amaranthus tuberculatus* | AMATU_PPO2_F420M | 110 |
| Uracilpyridine 1 | *Amaranthus tuberculatus* | AMATU_PPO2_L397D | 50 |
| Uracilpyridine 1 | *Amaranthus tuberculatus* | AMATU_PPO2_L397D_F420V | 41 |
| Uracilpyridine 1 | *Amaranthus tuberculatus* | AMATU_PPO2_R128A_F420M | 50 |
| Uracilpyridine 1 | *Amaranthus tuberculatus* | AMATU_PPO2_R128A_F420V | 75 |
| Uracilpyridine 1 | *Arabidopsis thaliana* | ARBTH_PPO1_WT | 50 |
| Uracilpyridine 1 | *Arabidopsis thaliana* | ARBTH_PPO1_S305L_Y426M | 250 |
| Uracilpyridine TABLE ii Transgenic T2 Arabidopsis plants, sprayed post in the greenhouse with the indicated amount of PPO inhibitor + 1% (v/v) MSO. Evaluation performed 14 Days After Treatment (DAT) and is shown as injury (%) relative to non-transgenic treated plants.

| Compound | gai/ha | ARBTH WT MC24 - non-transgenic / | ARBTH_PPO1_WT Q | AMATU_PPO2_WT Q | ALOMY_PPO2_TP_AMATU_PPO2_R128M_F420I R | AMATU_PPO2_R128M_F420I R | AMATU_PPO2_R128M_F420I K |
|---|---|---|---|---|---|---|---|
| Uracilpyridine 2 | 200 | 100 | | | 75 | | 70 |
| | 100 | 100 | | | 45 | | 58 |
| | 80 | 100 | | | | | |
| | 50 | 100 | | | 45 | | 18 |
| | 30 | 100 | | | | | |
| | 10 | 100 | | | | | |
| | 5 | 100 | | | | | |
| | 1 | 100 | | | | | |
| Uracilpyridine 3 | 80 | 100 | 100 | 100 | | | |
| | 30 | 100 | 100 | 100 | | | |
| | 10 | 100 | 98 | 100 | | | |
| | 5 | 100 | 83 | 80 | | | |
| | 1 | 88 | 10 | 48 | | | |
| Uracilpyridine 4 | 200 | 100 | | | 80 | | 73 |
| | 100 | 100 | | | 60 | | 58 |
| | 80 | 100 | | | | | |
| | 50 | 100 | | | 40 | | 30 |
| | 30 | 100 | | | | | |
| | 10 | 100 | | | | | |
| | 5 | 100 | | | | | |
| | 1 | 100 | | | | | |
| Uracilpyridine 5 | 80 | 100 | 100 | 100 | | | |
| | 30 | 100 | 100 | 100 | | | |
| | 10 | 100 | 99 | 88 | | | |
| | 5 | 100 | 90 | 25 | | | |
| | 1 | 100 | 45 | | | | |
| Uracilpyridine 1 | 200 | 100 | 100 | 100 | 84 | | 75 |
| | 100 | 100 | 100 | 100 | 92 | | 73 |
| | 50 | 100 | | 90 | 60 | | 60 |
| Uracilpyridine 10 | 200 | 100 | | 28 | | | |
| | 100 | | | | | | |
| | 50 | | | | | | |
| Uracilpyridine 6 | 200 | | | | | | |
| | 100 | | | | | | |
| | 50 | | | | | | |
| Uracilpyridine 7 | 200 | | | | | | |
| | 100 | | | | | | |
| | 50 | | | | | | |

TABLE ii-continued

Transgenic T2 Arabidopsis plants, sprayed post in the greenhouse with the indicated amount of PPO inhibitor + 1% (v/v) MSO. Evaluation performed 14 Days After Treatment (DAT) and is shown as injury (%) relative to non-transgenic treated plants.

| | | AMATU_PPO2_R128A_F420M Q | AMATU_PPO2_TP_hemG R | AMATU_PPO2_TP_hemG R | ALOMY_PPO2_R137L_F438V F | ALOMY_PPO2_R137L_F438V G |
|---|---|---|---|---|---|---|
| Uracilpyridine 8 | 80 | 100 | | 100 | | |
| | 30 | 100 | | 100 | | |
| | 10 | 100 | | 55 | | |
| | 5 | 88 | | 10 | | |
| | 1 | | | | | |
| Uracilpyridine 9 | 80 | 100 | 98 | 100 | | |
| | 30 | 100 | 70 | 100 | | |
| | 10 | 100 | 50 | 68 | | |
| | 5 | 85 | 10 | 38 | | |
| | 1 | | | | | |
| Uracilpyridine 10 | 80 | 100 | 100 | 100 | | |
| | 30 | 100 | 100 | 100 | | |
| | 10 | 100 | 98 | 100 | | |
| | 5 | 100 | 50 | 58 | | |
| | 1 | | | | | |

| Compound | gai/ha | AMATU_PPO2_R128A_F420M Q | AMATU_PPO2_TP_hemG R | AMATU_PPO2_TP_hemG R | ALOMY_PPO2_R137L_F438V F | ALOMY_PPO2_R137L_F438V G |
|---|---|---|---|---|---|---|
| Uracilpyridine 2 | 200 | 65 | 35 | 30 | 23 | 20 |
| | 100 | 15 | 40 | 33 | 18 | 10 |
| | 80 | | | | | |
| | 50 | | | | | |
| | 30 | 10 | 55 | 28 | 18 | 0 |
| | 10 | | | | | |
| | 5 | | | | | |
| | 1 | | | | | |
| Uracilpyridine 3 | 80 | | | | | |
| | 30 | | | | | |
| | 10 | | | | | |
| | 5 | | | | | |
| | 1 | | | | | |
| Uracilpyridine 4 | 200 | 60 | 65 | 30 | 20 | 8 |
| | 100 | 60 | 38 | | 20 | 15 |
| | 80 | | | | | |
| | 50 | 55 | 30 | 28 | 8 | 8 |
| | 30 | | | | | |
| | 10 | | | | | |
| | 5 | | | | | |
| | 1 | | | | | |
| Uracilpyridine 5 | 80 | | | | | |
| | 30 | | | | | |
| | 10 | | | | | |
| | 5 | | | | | |
| | 1 | | | | | |

TABLE ii-continued

Transgenic T2 Arabidopsis plants, sprayed post in the greenhouse with the indicated amount of PPO inhibitor + 1% (v/v) MSO. Evaluation performed 14 Days After Treatment (DAT) and is shown as injury (%) relative to non-transgenic treated plants.

| Compound | gai/ha | AMATU_PPO2_R128A_F420V A | AMATU_PPO2_R128A_F420V D | AMATU_PPO2_L397E_F420V D | AMATU_PPO2_L397E_F420V L | ARB1TH_PPO1_S305L_Y426M O |
|---|---|---|---|---|---|---|
| Uracilpyridine 1 | 200 | 75 | 53 | 65 | | 28 |
|  | 100 | 60 | 63 | 33 | | 75 |
|  | 50 | 55 | 60 | 20 | | 5 |
| Uracilpyridine 10 | 200 | | | 10 | | 5 |
|  | 100 | | | 8 | | 0 |
|  | 50 | | | 0 | | 0 |
| Uracilpyridine 6 | 200 | | | 18 | | 0 |
|  | 100 | | | 0 | | 0 |
|  | 50 | | | 0 | | 0 |
| Uracilpyridine 7 | 200 | | | 13 | | 8 |
|  | 100 | | | 18 | | 0 |
|  | 50 | | | 0 | | 0 |
| Uracilpyridine 8 | 80 | | | | | |
|  | 30 | | | | | |
|  | 10 | | | | | |
|  | 5 | | | | | |
|  | 1 | | | | | |
| Uracilpyridine 9 | 80 | | | | | |
|  | 30 | | | | | |
|  | 10 | | | | | |
|  | 5 | | | | | |
|  | 1 | | | | | |
| Uracilpyridine 10 | 80 | | | | | |
|  | 30 | | | | | |
|  | 10 | | | | | |
|  | 5 | | | | | |
|  | 1 | | | | | |
| Uracilpyridine 2 | 200 | | | | | 45 |
|  | 100 | | | | | |
|  | 80 | | | | | |
|  | 50 | | | | | |
|  | 30 | | | | | |
|  | 10 | | | | | |
|  | 5 | | | | | |
|  | 1 | | | | | |
| Uracilpyridine 3 | 80 | | | | | 33 |
|  | 30 | | | | | 0 |
|  | 10 | | | | | 0 |
|  | 5 | | | | | 13 |
|  | 1 | | | | | 49 |
| Uracilpyridine 4 | 200 | | | | | 0 |
|  | 100 | | | | | 0 |
|  | 80 | | | | | 95 |
|  | 50 | | | | | |
|  | 30 | | | | | 0 |

TABLE ii-continued

Transgenic T2 Arabidopsis plants, sprayed post in the greenhouse with the indicated amount of PPO inhibitor + 1% (v/v) MSO. Evaluation performed 14 Days After Treatment (DAT) and is shown as injury (%) relative to non-transgenic treated plants.

| Compound | Rate | | | | |
|---|---|---|---|---|---|
| Uracilpyridine 5 | 10 | | | | 0 |
|  | 5 | | | | 0 |
|  | 1 | | | | 73 |
| Uracilpyridine 1 | 80 | | | | 68 |
|  | 30 | | | | 0 |
|  | 10 | | | | 0 |
|  | 5 | | | |  |
|  | 1 | | | |  |
| 50 | 200 | | | |  |
|  | 100 | | | |  |
| Uracilpyridine 10 | 200 | 68 | 88 | 13 | 20 |
|  | 100 | 53 | 78 | 5 | 53 |
|  | 50 | 38 | 30 | 0 | 8 |
| Uracilpyridine 6 | 200 | 30 | 28 | 8 | 15 |
|  | 100 | 43 | 38 | 0 | 0 |
|  | 50 | 0 | 0 | 0 | 0 |
| Uracilpyridine 7 | 200 | 70 | 75 | 10 | 33 |
|  | 100 | 50 | 65 | 0 | 0 |
|  | 50 | 13 | 33 | 0 | 0 |
| Uracilpyridine 8 | 80 | | | | 0 |
|  | 30 | | | | 0 |
|  | 10 | | | | 0 |
|  | 5 | | | |  |
|  | 1 | | | |  |
| Uracilpyridine 9 | 80 | | | | 0 |
|  | 30 | | | | 0 |
|  | 10 | | | | 0 |
|  | 5 | | | |  |
|  | 1 | | | |  |
| Uracilpyridine 10 | 80 | | | | 99 |
|  | 30 | | | | 99 |
|  | 10 | | | | 8 |
|  | 5 | | | | 10 |
|  | 1 | | | |  |

TABLE iii

Transgenic T2 Arabidopsis plants, sprayed post in the greenhouse with the indicated amount of PPO inhibitor + 1% (v/v) MSO. Evaluation performed 14 Days After Treatment (DAT) and is shown as injury (%) relative to non-transgenic treated plants.

| Compound | g ai/ha | ARBTH WT MC 24 (non-transgenic) | ALOMY_PPO2_R137L_F438M | ALOMY_PPO2_R137L_F438M |
|---|---|---|---|---|
| Uracilpyridine 2 | 100 | 100 | 0 | 0 |
|  | 50 | 100 | 0 | 0 |
| Uracilpyridine 4 | 100 | 100 | 0 | 0 |
|  | 50 | 100 | 0 | 0 |
| Uracilpyridine 1 | 100 | 100 | 20 | 0 |
|  | 50 | 100 | 0 | 0 |

| Compound | g ai/ha | ALOMY_PPO2_R137L_F438M | ALOMY_PPO2_R137L_F438M | ALOMY_PPO2_R137L_F438V |
|---|---|---|---|---|
| Uracilpyridine 2 | 100 | 0 | 0 | 0 |
|  | 50 | 0 | 0 | 0 |
| Uracilpyridine 4 | 100 | 0 | 0 | 0 |
|  | 50 | 0 | 0 | 10 |
| Uracilpyridine 1 | 100 | 0 | 0 | 0 |
|  | 50 | 0 | 0 | 5 |

| Compound | g ai/ha | ALOMY_PPO2_R137L_F438V | ALOMY_PPO2_R137L_F438V | ALOMY_PPO2_R137L_F438V |
|---|---|---|---|---|
| Uracilpyridine 2 | 100 | 0 | 0 | 0 |
|  | 50 | 0 | 0 | 0 |
| Uracilpyridine 4 | 100 | 10 | 10 | 10 |
|  | 50 | 0 | 0 | 0 |
| Uracilpyridine 1 | 100 | 25 | 35 | 40 |
|  | 50 | 50 | 15 | 0 |

| Compound | g ai/ha | AMATU_PPO2_L397E_F420V | AMATU_PPO2_L397E_F420V | AMATU_PPO2_L397E_F420V |
|---|---|---|---|---|
| Uracilpyridine 2 | 100 | 0 | 0 | 0 |
|  | 50 | 0 | 0 | 0 |
| Uracilpyridine 4 | 100 | 0 | 30 | 0 |
|  | 50 | 0 | 10 | 0 |
| Uracilpyridine 1 | 100 | 0 | 35 | 55 |
|  | 50 | 0 | 10 | 0 |

| Compound | g ai/ha | AMATU_PPO2_L397E_F420V | AMATU_PPO2_L397E_F420M | AMATU_PPO2_L397E_F420M |
|---|---|---|---|---|
| Uracilpyridine 2 | 100 | 0 | 10 | 35 |
|  | 50 | 15 | 0 | 0 |
| Uracilpyridine 4 | 100 | 0 | 15 | 35 |
|  | 50 | 10 | 0 | 25 |
| Uracilpyridine 1 | 100 | 0 | 15 | 30 |
|  | 50 | 35 | 0 | 10 |

| Compound | g ai/ha | AMATU_PPO2_L397E_F420M | AMATU_PPO2_L397E_F420M | AMATU_PPO2_L397Q_F420V |
|---|---|---|---|---|
| Uracilpyridine 2 | 100 | 0 | 20 | 80 |
|  | 50 | 0 | 0 | 45 |
| Uracilpyridine 4 | 100 | 60 | 20 | 80 |
|  | 50 | 0 | 0 | 60 |
| Uracilpyridine 1 | 100 | 60 | 55 | 85 |
|  | 50 | 15 | 40 | 40 |

| Compound | g ai/ha | ARBTH WT MC 24 (non-transgenic) | AMATU_PPO2_L397Q_F420V | AMATU_PPO2_R128A_F420L |
|---|---|---|---|---|
| Uracilpyridine 2 | 100 | 100 | 65 | 60 |
|  | 50 | 100 | 0 | 0 |
| Uracilpyridine 4 | 100 | 100 | — | 10 |
|  | 50 | 100 | — | 0 |
| Uracilpyridine 1 | 100 | 100 | 65 | 60 |
|  | 50 | 100 | 75 | 65 |

| Compound | g ai/ha | AMATU_PPO2_R128A_F420L | AMATU_PPO2_R128A_F420L | AMATU_PPO2_R128A_F420L |
|---|---|---|---|---|
| Uracilpyridine 2 | 100 | 35 | 15 | 30 |
|  | 50 | 0 | 0 | 15 |
| Uracilpyridine 4 | 100 | 65 | 20 | 20 |
|  | 50 | 10 | 0 | 0 |
| Uracilpyridine 1 | 100 | 90 | 95 | 80 |
|  | 50 | 75 | 5 | 75 |

| Compound | g ai/ha | AMATU_PPO2_R128A_F420I | AMATU_PPO2_R128A_F420I | AMATU_PPO2_R128A_F420I |
|---|---|---|---|---|
| Uracilpyridine 2 | 100 | 65 | 65 | 65 |
|  | 50 | 0 | 45 | 65 |

TABLE iii-continued

Transgenic T2 Arabidopsis plants, sprayed post in the greenhouse with the indicated amount of PPO inhibitor + 1% (v/v) MSO. Evaluation performed 14 Days After Treatment (DAT) and is shown as injury (%) relative to non-transgenic treated plants.

| Uracilpyridine 4 | 100 | 65 | 50 | 55 |
| | 50 | 0 | 50 | 40 |
| Uracilpyridine 1 | 100 | 65 | 80 | 95 |
| | 50 | 70 | 75 | 60 |

| Compound | g ai/ha | AMATU_PPO2_R128A_F420I | AMATU_PPO2_R128A_F420M | AMATU_PPO2_R128A_F420M |
|---|---|---|---|---|
| Uracilpyridine 2 | 100 | 30 | 0 | 65 |
| | 50 | 0 | 0 | 0 |
| Uracilpyridine 4 | 100 | 65 | 25 | 65 |
| | 50 | 50 | 0 | 15 |
| Uracilpyridine 1 | 100 | 60 | 35 | 80 |
| | 50 | 60 | 55 | 65 |

| Compound | g ai/ha | AMATU_PPO2_R128A_F420M | AMATU_PPO2_R128A_F420M | AMATU_PPO2_R128A F420V |
|---|---|---|---|---|
| Uracilpyridine 2 | 100 | 30 | 0 | 85 |
| | 50 | 30 | 0 | 0 |
| Uracilpyridine 4 | 100 | 40 | 45 | 15 |
| | 50 | 25 | 30 | 75 |
| Uracilpyridine 1 | 100 | 65 | 65 | 95 |
| | 50 | 25 | 40 | 90 |

| Compound | g ai/ha | AMATU_PPO2_R128A F420V | AMATU_PPO2_R128A F420V | AMATU_PPO2_R128A F420V |
|---|---|---|---|---|
| Uracilpyridine 2 | 100 | 70 | 25 | 65 |
| | 50 | 0 | 20 | 0 |
| Uracilpyridine 4 | 100 | 75 | 25 | 40 |
| | 50 | 70 | 60 | 75 |
| Uracilpyridine 1 | 100 | 98 | 95 | 80 |
| | 50 | 55 | 65 | 95 |

Example 11: Demonstration of Herbicide Tolerance in Mutagenized Non-Transgenic Rice Selected mutants are transferred to pots and grown in the greenhouse for seed production. The resulting M1 progeny are screened for the presence and zygosity of tolerance conferring mutations in the OsPPO2 gene, e.g. mutated OsPPO2 polypeptides as shown in SEQ ID Nos: 628, 629, 630, 631, 632, 633, 634, 635, 636, or 637. M1 plants containing a homozygous in the OsPPO2 gene are kept for seed production to generate a stable, homozygous, herbicide tolerant line. Homozygous lines ca. 2 weeks old are sprayed using a track sprayer with uracilpyridine 2 or uracilpyridine 4 supplemented with 0.1% methylated seed oil. Once sprayed, plants are kept on drought conditions for 24 hours before being watered and fertilized again. Sprayed plants are photographed and rated for herbicide injury at 3 days and 7 days treatment. The results are shown in FIGS. 1 to 4.

Example 12: Herbicide Selection Using Tissue Culture

Media is selected for use and kill curves developed as specified above. For selection, different techniques are utilized. Either a step wise selection is applied, or an immediate lethal level of herbicide is applied. In either case, all of the calli are transferred for each new round of selection. Selection is 4-5 cycles of culture with 3-5 weeks for each cycle. Cali are placed onto nylon membranes to facilitate transfer (200 micron pore sheets, Biodesign, Saco, Me.). Membranes are cut to fit 100×20 mm Petri dishes and are autoclaved prior to use 25-35 calli (average weight/calli being 22 mg) are utilized in every plate. In addition, one set of calli are subjected to selection in liquid culture media with weekly subcultures followed by further selection on semi-solid media. Mutant lines are selected using the uracilpyridines as disclosed SUPRA, and photosynthesis inhibitor diuron as negative control. Efficiencies of obtaining mutants is high either based on a percentage of calli that gave rise to a regenerable, mutant line or the number of lines as determined by the gram of tissue utilized.

Example 13: Maize Whole Plant Transformation and PPO Inhibitor Tolerance Testing Immature embryos are transformed according to the procedure outlined in Peng et al. (WO2006/136596). Plants are tested for the presence of the T-DNA by Taqman analysis with the target being the nos terminator which is present in all constructs. Healthy looking plants are sent to the greenhouse for hardening and subsequent spray testing. The plants are individually transplanted into MetroMix 360 soil in 4" pots. Once in the greenhouse (day/night cycle of 27° C./21° C. with 14 hour day length supported by 600 W high pressure sodium lights), they are allowed to grow for 14 days. T0 or T1 plants are sprayed with a treatment of the uracilpyridines as disclosed SUPRA and photosynthesis inhibitor diuron as negative control. Herbicide injury evaluations are taken at 7, 14 and 21 days after treatment. Herbicide injury evaluations are taken 2, 7, 14 and 21 days post-spray to look for injury to new growth points and overall plant health. The top survivors are transplanted into gallon pots filled with MetroMix 360 for seed production.

Transgenic T2 Corn plants harbouring PPO inhibitor tolerance trait, were sprayed post with the indicated amount of uracilpyridine+1% (v/v) MSO. Evaluation performed 14 Days After Treatment (DAT) and shown as injury (0-9) relative to non-transgenic treated plants. Injury Scale: 0-9, 0=no injury, 9=maximum injury. Note: segregating lines. The results are shown in the following Table and in FIGS. 7 and 8.

| Compound | Rate (g/ha) | Corn Trial | | | |
|---|---|---|---|---|---|
| | | R128A, F420I Event 1 | R128A, F420L Event 2 | R128A, F420L Event 3 | J553 non transgenic |
| Check | | 0 | 0 | 1 | 5 |
| | | 1 | 1 | 1 | 6 |
| | | 1 | 2 | 0 | 6 |
| 1% MSO | | 0 | 0 | 0 | 1 |
| | | 1 | 0 | 0 | 2 |
| | | 1 | 1 | 1 | 1 |
| Uracilpyridine 2 | 25 | 1 | 0 | 1 | 9 |
| | | 0 | 1 | 0 | 9 |
| | | 1 | 0 | 0 | 9 |
| Uracilpyridine 2 | 50 | 0 | 1 | 0 | 9 |
| | | 1 | 1 | 0 | 9 |
| | | 0 | 1 | 1 | 9 |
| Uracilpyridine 2 | 100 | 1 | 1 | 0 | 9 |
| | | 0 | 1 | 1 | 9 |
| | | 1 | 1 | 1 | 9 |
| Uracilpyridine 4 | 25 | 0 | 0 | 0 | 9 |
| | | 0 | 0 | 1 | 7 |
| | | 0 | 0 | 0 | 7 |
| Uracilpyridine 4 | 50 | 0 | 1 | 1 | 9 |
| | | 1 | 0 | 0 | 7 |
| | | 0 | 1 | 0 | 9 |
| Uracilpyridine 4 | 100 | 1 | 0 | 1 | 9 |
| | | 0 | 1 | 0 | 9 |
| | | 0 | 1 | 0 | 9 |

Transgenic T3Maize plants harboring a PPO inhibitor tolerance trait sprayed post in the field at the V3 leaf stage with 100 g/ha of PPO inh. 2+1% (v/v) MSO. Evaluation performed 2 and 12 Days After Treatment (DAT) and is shown as injury (%) relative to non-transgenic treated plants. Pictures taken 2 DAT.

| | Plant Injury (%) | | |
|---|---|---|---|
| DAT | J553/TR5753 Non-transgenic | AMATU_PPO2_R128A_F420L | AMATU_PPO2_R128A_F420I |
| 2 | 95 | 0 | 0 |
| 12 | 100 | 0 | 0 |

Example 14: Soybean Transformation and PPO Inhibitor Tolerance Testing

Soybean cv Jake is transformed as previously described by Siminszky et al., Phytochem Rev. 5:445-458 (2006). After regeneration, transformants are transplanted to soil in small pots, placed in growth chambers (16 hr day/8 hr night; 25° C. day/23° C. night; 65% relative humidity; 130-150 microE m-2 s-1) and subsequently tested for the presence of the T-DNA via Taqman analysis. After a few weeks, healthy, transgenic positive, single copy events are transplanted to larger pots and allowed to grow in the growth chamber. An optimal shoot for cutting is about 3-4 inches tall, with at least two nodes present. Each cutting is taken from the original transformant (mother plant) and dipped into rooting hormone powder (indole-3-butyric acid, IBA). The cutting is then placed in oasis wedges inside a bio-dome. The mother plant is taken to maturity in the greenhouse and harvested for seed. Wild type cuttings are also taken simultaneously to serve as negative controls. The cuttings are kept in the bio-dome for 5-7 days and then transplanted to 3 inch pots and then acclimated in the growth chamber for two more days. Subsequently, the cuttings are transferred to the greenhouse, acclimated for approximately 4 days prior to spray. T0 or 2-week old T1 plants are sprayed with a treatment of the uracilpyridines as disclosed SUPRA and photosynthesis inhibitor diuron as negative control. Herbicide injury evaluations are taken at 2, 7, 14 and 21 days after treatment.

Transgenic T2 or T3 Soybean plants harbouring PPO inhibitor tolerance trait, were sprayed post in the greenhouse with the indicated amount of uracilpyridine+1% (v/v) MSO. Evaluation performed 7 Days After Treatment (DAT) and shown as injury (0-9) relative to non-transgenic treated plants. Injury Scale: 0-9, 0=no injury, 9=maximum injury. Note: segregating lines.

| Compound | Rate (g/ha) | R128A, F420L Event 1 | R128A, F420I Event 2 | L397E, F420V Event 3 | L397E, F420M Event 4 | L397Q, F420M Event 5 | Jake non transgenic |
|---|---|---|---|---|---|---|---|
| Uracilpyridine 1 | 25 | 1 | 1 | 2 | 1 | 1 | 9 |
| | | 1 | 1 | 1 | 2 | 2 | 9 |
| | | 1 | * | 1 | 1 | 2 | 9 |
| | | 1 | 9 | 1 | 1 | 1 | 9 |
| Uracilpyridine 1 | 50 | 1 | 1 | 9 | 2 | 1 | 9 |
| | | 1 | * | 1 | 0 | 2 | 9 |
| | | 1 | * | 1 | 1 | 1 | 9 |
| | | 1 | 3 | 2 | 1 | 2 | 9 |
| Uracilpyridine 1 | 100 | 1 | 1 | 1 | 1 | 3 | 9 |
| | | 1 | 2 | 1 | 2 | 2 | 9 |
| | | 1 | * | 9 | * | * | 9 |
| | | 4 | 1 | 9 | 1 | 3 | 9 |
| Uracilpyridine 1 | 200 | 1 | 1 | 9 | 4 | 3 | 9 |
| | | 1 | 1 | 2 | 1 | 3 | 9 |
| | | 1 | 1 | 9 | 2 | * | 9 |
| | | 1 | 1 | 1 | 2 | 4 | 9 |
| 1% MSO | | 1 | * | 1 | 1 | 1 | 3 |
| | | 1 | * | 2 | 1 | 2 | 2 |
| | | 1 | 1 | 1 | 2 | 2 | 2 |
| | | 2 | * | 1 | 1 | 1 | 3 |

-continued

| Compound | Rate (g/ha) | R128A, F420L Event 1 | R128A, F420I Event 2 | L397E, F420V Event 3 | L397E, F420M Event 4 | L397Q, F420M Event 5 | Jake non transgenic |
|---|---|---|---|---|---|---|---|
| | Check | 1 | * | 0 | 1 | 0 | 1 |
| | | 0 | 0 | 1 | 1 | 2 | 0 |
| | | 0 | * | * | 1 | * | 1 |
| | | 1 | * | 2 | 1 | * | 1 |

Transgenic T2 or T3 Soybean plants harbouring PPO inhibitor tolerance trait, were sprayed post with the indicated amount of uracilpyridine+1% (v/v) MSO. Evaluation performed 14 Days After Treatment (DAT) and shown as injury (0-9) relative to non-transgenic treated plants. Injury Scale: 0-9, 0=no injury, 9=maximum injury. Note: segregating lines. The results are shown in the following Table and in FIGS. 7 and 8.

| | | Soybean Trial | | | |
|---|---|---|---|---|---|
| Compound | Rate (g/ha) | L397E, F420V Event 1 | L397E, F420M Event 2 | L397Q, F420M Event 3 | Jake non transgenic |
| Check | | 0 | 9 | 9 | 9 |
| | | 0 | 0 | 2 | 9 |
| | | 0 | 2 | 1 | 9 |
| 1% MSO | | 0 | 0 | 0 | 1 |
| | | 0 | 0 | 0 | 1 |
| | | 0 | 0 | 0 | 1 |
| Uracilpyridine 2 | 25 | 0 | 0 | 0 | 9 |
| | | 0 | 0 | 9 | 9 |
| | | 0 | 0 | 3 | 9 |
| Uracilpyridine 2 | 50 | 0 | 0 | 3 | 9 |
| | | 0 | 0 | 9 | 9 |
| | | 0 | 0 | 1 | 9 |
| Uracilpyridine 2 | 100 | 0 | 0 | 1 | 9 |
| | | 0 | 0 | 3 | 9 |
| | | 0 | 0 | 2 | 9 |
| Uracilpyridine 4 | 25 | 0 | 0 | 1 | 9 |
| | | 0 | 0 | 9 | 9 |
| | | 0 | 0 | 0 | 9 |
| Uracilpyridine 4 | 50 | 0 | 0 | 9 | 9 |
| | | 0 | 0 | 9 | 9 |
| | | 0 | 0 | 3 | 9 |
| Uracilpyridine 4 | 100 | 0 | 0 | 3 | 9 |
| | | 0 | 0 | 4 | 9 |
| | | 0 | 1 | 3 | 9 |

Transgenic T4 Soybean plants harbouring PPO inhibitor tolerance trait, were sprayed post with the indicated amount of uracilpyridine+1% (v/v) MSO. Evaluation performed 7 Days After Treatment (DAT) and shown as injury (0-9) relative to non-transgenic treated plants. Injury Scale: 0-9, 0=no injury, 9=maximum injury. Asterisks indicates plants that did not germinate. Results are also shown in FIGS. 9 through 12.

| Compound | Rate (g/ha) | R128A + F420L Event 1 | R128A + F420I Event 2 | L397E + F420V Event 3 | L397E + F420M Event 4 | L397Q + F420M Event 5 | Jake non-transgenic |
|---|---|---|---|---|---|---|---|
| Uracilpyridine 10 | 25 | 0 | 1 | 1 | 0 | 3 | 9 |
| | | 1 | 0 | 1 | 1 | * | 9 |
| | | 0 | 2 | 0 | 0 | 3 | 9 |
| | | 0 | 1 | 0 | 0 | 5 | 9 |
| | | 1 | 1 | * | 0 | * | * |
| | | 0 | 1 | * | 0 | 3 | 9 |
| Uracilpyridine 10 | 50 | 1 | 1 | * | 0 | 4 | 9 |
| | | 1 | 2 | 1 | 1 | 4 | 9 |
| | | 0 | 1 | * | 0 | 4 | 9 |
| | | 1 | 2 | * | 0 | 4 | 9 |
| | | 0 | 2 | 0 | 0 | 4 | 9 |
| | | 1 | 2 | 1 | 1 | 4 | 9 |

-continued

| Compound | Rate (g/ha) | R128A + F420L Event 1 | R128A + F420I Event 2 | L397E + F420V Event 3 | L397E + F420M Event 4 | L397Q + F420M Event 5 | Jake non-transgenic |
|---|---|---|---|---|---|---|---|
| Uracilpyridine 10 | 100 | 2 | 2 | * | 1 | 9 | |
|  |  | 1 | 2 | 0 | 2 | 4 | 9 |
|  |  | 2 | 2 | 0 | 1 | * | 9 |
|  |  | 2 | 3 | 0 | 1 | 5 | 9 |
|  |  | 2 | 3 | 1 | 0 | 5 | 9 |
|  |  | 2 | 3 | * | 1 | * | 9 |
| Uracilpyridine 20 | 25 | 2 | 2 | 0 | 0 | 4 | 9 |
|  |  | 0 | 2 | 1 | 0 | 3 | 9 |
|  |  | 1 | 2 | 0 | 1 | * | 9 |
|  |  | 0 | 2 | * | 0 | 3 | 9 |
|  |  | 1 | 2 | 0 | 0 | * | 9 |
|  |  | 2 | 1 | * | 0 | 3 | 9 |
| Uracilpyridine 20 | 50 | 3 | 3 | 0 | 0 | * | 9 |
|  |  | 3 | 3 | 0 | 1 | * | 9 |
|  |  | 2 | 3 | 0 | 0 | 3 | 9 |
|  |  | 1 | 2 | 1 | 1 | 4 | 9 |
|  |  | 2 | 3 | 1 | 0 | 4 | 9 |
|  |  | 2 | 3 | 0 | 0 | 4 | 9 |
| Uracilpyridine 20 | 100 | 3 | 4 | * | 0 | * | 9 |
|  |  | 4 | 4 | 0 | 0 | 4 | 9 |
|  |  | 5 | 4 | 0 | 1 | * | 9 |
|  |  |  | 4 | * | 1 | 4 | 9 |
|  |  | 5 | 4 | 0 | 1 | 7 | 9 |
|  |  | * | 4 | 2 | 1 | * | 9 |
| Uracilpyridine 21 | 25 | 0 | 0 | 0 | 0 | 3 | 9 |
|  |  | 1 | 1 | 0 | 0 | 2 | 9 |
|  |  | 1 | 1 | * | 0 | 2 | 9 |
|  |  | 1 | 1 | 0 | 0 | 3 | 9 |
|  |  | 1 | 1 | * | 0 | * | 9 |
|  |  | 1 | 1 | * | 1 | 2 | 9 |
| Uracilpyridine 21 | 50 | 1 | 2 | 0 | 0 | 3 | 9 |
|  |  | 2 | 2 | * | 0 | * | 9 |
|  |  | 1 | 1 | 0 | 0 | 3 | 9 |
|  |  | 1 | 2 | 0 | 0 | 3 | 9 |
|  |  | 2 | 2 | 0 | 1 | 3 | 9 |
|  |  | 1 | 2 | 0 | 1 | * | 9 |
| Uracilpyridine 21 | 100 | 2 | 3 | * | 0 | 3 | 9 |
|  |  | 1 | 3 | * | 0 | 3 | 9 |
|  |  | 4 | 2 | 0 | 0 | * | 9 |
|  |  | 2 | 3 | 2 | 0 | 3 | 9 |
|  |  | 2 | 2 | 0 | 0 | 3 | 9 |
|  |  | 2 | 3 | 0 | 1 | * | 9 |
| Uracilpyridine 22 | 25 | 0 | 1 | * | 1 | * | 9 |
|  |  | 0 | 0 | 0 | 0 | 1 | 9 |
|  |  | 0 | 0 | 0 | 0 | * | 9 |
|  |  | 1 | 1 | 0 | 0 | 1 | 9 |
|  |  | 0 | 2 | 0 | 0 | 2 | 9 |
|  |  | 1 | 1 | 1 | 1 | 1 | 9 |
| Uracilpyridine 22 | 50 | 1 | 0 | 0 | 1 | 3 | 9 |
|  |  | 1 | 0 | 0 | 0 | 3 | 9 |
|  |  | 1 | 3 | 0 | 2 | 3 | 9 |
|  |  | 1 | 2 | 0 | 1 | 2 | 9 |
|  |  | 2 | 2 | * | 0 | * | 9 |
|  |  | 1 | 2 | * | 1 | 1 | 9 |
| Uracilpyridine 22 | 100 | 1 | 2 | * | 0 | * | 9 |
|  |  | 1 | 3 | 0 | 0 | 4 | 9 |
|  |  | 1 | 1 | 1 | 0 | 4 | 9 |
|  |  | 1 | 2 | 0 | 1 | * | 9 |
|  |  | 2 | 2 | 0 | 1 | 4 | 9 |
|  |  | 2 | 3 | 1 | 0 | 4 | 9 |

Transgenic T3 Soybean plants harboring a PPO inhibitor tolerance trait, sprayed post in the field at the V3 leaf stage with 100 g/ha of PPO inh. 2+1% (v/v) MSO. Evaluation performed 2 and 12 Days After Treatment (DAT) and is shown as injury (%) relative to non-transgenic treated plants. Pictures taken 2 DAT.

| EXP | Jake Non-transgenic | AMATU_PPO2_R128A, F420I | AMATU_PPO2_L397E, F420V | AMATU_PPO2_L397E, F420M | AMATU_PPO2_L397Q, F420M | DAT |
|---|---|---|---|---|---|---|
| | | | Plant Injury (%) | | | |
| PPO Inh. 2 | 92 | 10 | 0 | 5 | 5 | 2 |
| PPO Inh. 2 | 100 | 5 | 0 | 0 | 0 | 12 |

The following gives a definition of the injury scores measured above:

| Score | Description of injury |
|---|---|
| 0 | No Injury |
| 1 | Minimal injury, only a few patches of leaf injury or chlorosis. |
| 2 | Minimal injury with slightly stronger chlorosis. Overall growth points remain undamaged. |
| 3 | Slightly stronger injury on secondary leaf tissue, but primary leaf and growth points are still undamaged. |
| 4 | Overall plant morphology is slightly different, some chlorosis and necrosis in secondary growth points and leaf tissue. Stems are intact. Regrowth is highly probable within 1 week. |
| 5 | Overall plant morphology is clearly different, some chlorosis and necrosis on a few leaves and growth points, but primary growth point is intact. Stem tissue is still green. Regrowth is highly probably within 1 week. |
| 6 | Strong injury can be seen on the new leaflet growth. Plant has a high probability to survive only through regrowth at different growth points. Most of the leaves are chlorotic/necrotic but stem tissue is still green. May have regrowth but with noticeable injured appearance. |
| 7 | Most of the active growth points are necrotic. There may be a single growth point that could survive and may be partially chlorotic or green and partially necrotic. Two leaves may still be chlorotic with some green; the rest of the plant including stem is necrotic. |
| 8 | Plant will likely die, and all growth points are necrotic. One leaf may still be chlorotic with some green. The remainder of the plant is necrotic. |
| 9 | Plant is dead. |

SEQUENCE LISTING (650 sequences)

SEQ ID NO: 1 - protein, 534 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 2 - protein, 534 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARAGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 3 - protein, 533 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDCVLRAIDKMEKDLPGFFYAGNHKGGLSVGKAMASGCKAAELVISYLDSHIYVKMDEKTA

SEQ ID NO: 4 - protein, 533 aa, Amaranthus
MVIQSITHLSPNLALPSPLSVSTKNYPVAVMGNISEREEPTSAKRVAVVGAGVSGLAAAYKLKSHGLSVTLFEANSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGDPQSLSMYHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 5 - protein, 535 aa, Amaranthus
MVIQSITHLSPKLALPSPLSVSTKNYPVAVMGNISEREEPTSAKRVAVVGAGVSGLAAAYKLKSHGLNVTLFEADSRAGGKLKTVKKDGFIWDEGANTMTESEAEVSSLIDDLGLREKQQLPISQNKRYIARDGLPVLLPSNPAALLSSNILSAKSKLQIMLEPFLWRKRNATELSDEHVQESVGEFFERHFGKEFVDYVIDPFVAGTCGGDPQSLSVHHTFPDVWNVEKRFGSVFAGLIQSTLLSKKEKGGGENASIKKPRVRGSFSFHGGMQTLVDTMCKQIGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLAKASTDELKQIVSSDLQQLLGTEDEPSFVNHLFWSNAFPLYGHNYDSVLRAIDKMEKDLPGFFYAGNHKGGLSVGKAMASGCKAAELVISYLDSHLYVKMNEKTA

SEQ ID NO: 6 - protein, 505 aa, Amaranthus
MGNISERDEPTSAKRVAVVGAGVSGLAAAYKLKSHGLNVTLFEADSRAGGKLKTVKKDGFIWDEGANTMTESEAEVSSLIDDLGLREKQQLPISQNKRYIARDGLPVLLPSNPAALLTSNILSAKSKLQIMLEPFFWRKHNATELSDEHVQESVGEFFERHFGKEFVDYVIDPFVAGTCGGDPQSLSMHHTFPEVWNIEKRFGSVFAGLIQSTLLSKKEKGGGGNASIKKPRVRGSFSFHGGMQTLVDTICKQLGEDELKLQCEVLSLSYNQKGIPSLGNWSVSSMSNNTSEDQSYDAVVVTAPIRNVKEMKIMKFGNPFSLDFIPEVSYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 7 - protein, 531 aa, Spinacia
MVILPVSQLSTNLGLSLVSPTKNNPVMGNVSERNQVNQPISAKRVAVVGAGVSGLAAAYKLKSNGLNVTLFEADSRAGGKLKTVVKDGLIWDEGANTMTESDEEVTSLFDDLGIREKLQLPISQNKRYIARDGLPVLLPSNPVALLKSNILSAKSKLQIMLEPFLWKKHNGAKVSDENAQESVAEFFERHFGKEFVDYLIDPFVAGTSGGDPQSLSMRHAFPELWNIENRFGSVISGFIQSKLSSKKEKGGEKQSSNKKPRVRGSFSFQGGMQTLVDTICKEFGEDELKLQSEVLSLSYSHNGSLTSENWSVSSMSNSTIQDQPYDAVVVTAPINNVKELKIMKVENPFSLDFIPEVSCLPLSVIITTFKKTNVKRPLEGFGVLVPSNEQHNGLKTLGTLFSSMMFPDRAPSDVYLYTTFVGGSRNRELAKASTDELKQIVSSDLQQLLGTEGEPTFVNHFYWSKAFPLYGRNYDSVLRAIEKMERDLPGLFYAGNHKGGLSVGKSIASGYKAAELAISYLESNKMTEETI

SEQ ID NO: 8 - protein, 508 aa, Vicia
MAEKSDAQSHYNGSGKRVAVVGAGVSGLAAAYKLKLHGVNITLYEAEERAGGKLRSVSQHGLVWDEGANTMTESEIEVGSLLDNLRLREKQQFPISQNKRYIVRNGMPVLLPSNPIALIKSNILSAKSKFQIILEPFLWKKSDLSKVSDDHMKESVGGFFQRHFGKEVVDYLIDPFVAGTSGGDPESLSMHHTFPELWNLEKRFGSIIAGAVLSKLSAKREKRGETKGSSEKKKRQRGSFSFQGGMQTLTDTLCKELGKDKLRLKSKVLSLSYSHGEKSALENWSVAYASNPGKQSKDLSFDAVIMTAPLCNVREMKIMKKGNPFLLDFLPEVSYLPLSVIITTFKKENVKRPLEGFGVLVPSKEQQNGLKTLGTLFSSMMFPDRAPNDLYLYTTFIGGSRNRELAKASTDELKQIVTSDLRQLLGAEGEPTFVNHFYWSKAFPLFGHNYDSVLEAIDKMEKDLPGFFYAGNHKGGLSVGKAIASGCKAADLVISYLNSSSDGKMFKE

SEQ ID NO: 9 - protein, 511 aa, Ricinus <angiosperm>
MSSVIKEDRNPSHVKRVAVVGAGVSGLAAAYKLKSHGLKVTVFEAEERAGGKLRSVNHDGLIWDEGANTMTESEMEVKSLIGNLGIREKQQFPISQNKRYIVRNGKPILIPTNPIALITSNILSAQSKFQIILEPFLWKKRESSETHNAYTEESVGEFFQRHFGKEVVDYLIDPFVAGTSAGDPESLSVCHSFPELWNLEKRFGSIIAGVVQAKLSTKRGKSQETKGSSVKKKQQRGSFSFFGGMQTLTDTLCKALAKDELRLESKVFSLSYNPDSKSAVENWSLSYAFKGAKHLQNSSYDAIVMTAPLCNVKEMKITKNRNIFSLNFLPEVSYMPLSVVITTFKKDNVKSPLEGFGVLVPSKEQQNGLKTLGTLFSSMMFPDRAPNDLYLYTTFVGGSRNKELAKASTDDLKQIVTSDLRQLLGAEGEPTFVNHFYWSKAFPLYGRNYDAVLEAIDTMEKDLPGFFYAGNHKGGLSVGKAIASGCKAADLVISYLESSSDDKMLKEGPSN

SEQ ID NO: 10 - protein, 504 aa, Theobroma
MAAAKNKDKQTSAKRVAVVGAGVSGLAAAYKLKSHGLNVTMFEAEGRAGGKLRSVSQEGLIWDEGANTMTESEIEVRSLFDDLGIRDKQQVPIAQKKRYIVRNGVPVLIPSNPIALITSNILSAKSKFQIILEPFLWKKSDASKVSDAYNLESVGGFFQRHFGQEVVDYLIDPFVAGTSAGDPESLSMRHSFPELWDLEKRFGSIIVGAVKSKLSAKRENRGERKTSEKRKPLPGPFSFQGGMQTLTDMLCKDLSKDELKLKSKVLSLSYSHDGKSTLENWSLSYASDRDKRSQGSSFDAVVMTAPLCNVKEMKIMKGGKLFPLNFIPQVSYMPLSVIITTFKKENVKKPLEGFGVLVPSKEQQNGLKTLGTLFSSIMFPDRAPNNLYLYTTFVGGSRNKELAKASTDELKHIVTSDLRQLLGVEGEPTFLNHFYWSKAFPLYGRNYASVLKAIEKMETDLPGFFYAGNHKGGLSVGKAIASGCKAADLVISYLESSHQKLLKD

SEQ ID NO: 11 - protein, 502 aa, Glycine
MASSATDDNPRSVKRVAVVGAGVSGLAAAYKLKSHGLDVTVFEAEGRAGGRLRSVSQDGLIWDEGANTMTESEIEVKGLIDALGLQEKQQFPISQHKRYIVKNGAPLLVPTNPAALLKSKLLSAQSKIHLIFEPFMWKRSDPSNVCDENSVESVGRFFERHFGKEVVDYLIDPFVGGTSAADPESLSMRHSFPELWNLEKRFGSIIAGALQSKLFAKREKTGENRTALRKNKHKRGSFSFQGGMQTLTDTLCKELGKDDLKLNEKVLTLAYGHDGSSSSQNWSITSASNQSTQDVDAVIMTAPLYNVKDIKITKRGTPFPLNFLPEVSYVPISVMITTFKKENVKRPLEGFGVLVPSKEQKNGLKTLGTLFSSMMFPDRAPSDLYLYTTFIGGTQNRELAQASTDELRKIVTSDLRKLLGAEGEPTFVNHFYWSKGFPLYGRNYGSVLQAIDKIEKDLPGFFFAGNYKGGLSVGKAIASGCKAADLVISYLNSASDNTVPDK

SEQ ID NO: 12 - protein, 502 aa, Prunus
MTSLTTKEGSVKRVAVVGAGVSGLAAAYKLKSHGFDVTVFEAEGRAGGKLRSVSHDGLIWDEGANTMTESEKEVQTLLDDLGIREKQQFPISQNKRYIVRNGSPVLIPTNPIALIKSNFLSAQSKLQIILEPYLWKDKRVSDDHTEESVGGFFQRHFGEEVVDYLIDPFVAGTSAGDPESLSMRHSFPDIWNIEKRFGSVISGAIKSKLSASKGKSGETKGSVEKGKRQRGSFSFHGGMQTLTDILCNQLEKDELKLNSKVLSLSYRQGGNSASENWSVSRVADDDKHSQSLSVDALIMTAPLCNVKEMKITKRGTRFPLDFIPEVVYMPLSVIITTFKKENVKRPLEGFGVLVPSKEQKNGLKTLGTLFSSMMFPDRAPSDLYLYTTFVGGSRNKELAKASTDELKQIVTSDIRHLLGAEGEPTFVNHFYWSNAFPLYGRDYDSVIEAIENMEKNLPGFFYAGNHRGGLSVGKSIASGCKAAELVISYLESPSDEKTRHKG

SEQ ID NO: 13 - protein, 499 aa, Medicago
MASSAKDDNPRSVKRVAVVGAGVSGLAAAYKLKSHGLDVTVFEAEGRAGGRLRTVSRDGLVWDEGANTMTENEIEVKGLIDALGLHEKQQYPLSQHKRYIVKNGTPVLVPANPAALLKSKLLSAQSKIQVIFEPFMWKRSDSSAVRDENSEESVSRFFERHFGKEVVDYLIDPFVGGTSAAGPESLSIRHSFPELWNLEKRFGSIIAGALQSSVFGKKDKAGETKDVPRKNKHQRGSFSFQGGMQTLTDTLCKELGKDDIKLNAKVLTLAYSHDGSSPSQNWSITCTSNRKAQDVDAVIMTAPLGNVRDIQIKKKGNPFPLNFLPEVTYLPLSVLITTFKKENVKRPLEGFGVLVPSKEQQNGFKTLGTLFSSMMFPDRAPSDMHLYTTFIGGTRNRELAQASTDELTKIVTSDLRKLLGAEGEPAFVNHFFWSKGFPLYGHNYGSVLEAIDKMEKDLPGFFYAGNHRGGLSVGRAIASGCKAADLVISYLNNASDNSV

SEQ ID NO: 14 - protein, 506 aa, Fragaria
MASPSQPHNHRSVKKVAVVGAGVSGLAAAYKLKSHGFDVTVLEAEGRAGGKLRSVSYNGLIWDEGANTMTEAETEVQTLLDSLGLRDKQQFPISQNKRYVARNGMPVLLPTNPIELIKSNFLSTKSKFQILLEPYLWKKKKVSDDHTQESVAGFFQRHFGKEVVDYLIDPFVAGTSAGDPESLSMPHSFPELWNIEKRYGSVITGTIRSKVSSRKEKRGDTKGSVEKGKRQRGSFSFQGGMQTLTDTLCKQLGKHELKLNSKVLSLSYSHDGSSTSENWSLSCVANDDKHSQSSSVDAIIMTAPLCSIKEMKITRRGTIFPLDFLPEVNYMPLSVLITSFKKENIKRPLEGFGVLVPSKEQENGLKTLGTLFSSMMFPDRAPSDQYLYTTFVGGSRNKELAKASKDELKQIVTSDIRQLLGAEGEPTFVNHYYWSKAFPLYGHNYDSVIEAIEKMEKNLPGLFYAGNHRGGLSVGKAIASGCKAADLVISYLESSSDGKILQQGSS

SEQ ID NO: 15 - protein, 509 aa, Citrus
MASAPGEDNQRSAKRVAVVGAGVSGLAAAYKLKSNGVNVMVFEADERAGGKLRSISKDGLIWDEGANTMTESEMEVKGLLDDLGIREKQQFPISQYKRYVVRNGVPFLIPTNPIALITSNFLSAQSKFQIILEPFLWKKSDSAKVSAEDAKESVGGFFQRHFGREVVDFLIDPFVAGTSAADPESLVMRHSFPELWNLEKRYGSVIAGAIKSKFSARKEKSAEAKGSSEKKHRQRGSFSFLGGMQTLTDALCKALGKDEVCLKSKVLSLSYSHDGKSALENWSLSSSNQDKQSQGLSFDAVIMTASLCNVKEMKITKGGNLFPLDFLPEVIYMPLSVFITAFKKENVGKPLQGFGVLVPSKEQQNGLKTLGTLFSSMMFPDRAPKDLFLYTTFVGGSRNKELAKASTDELKQIVTSDLRQLLGVEGEPTFVNHFFWSKAFPLYGRDYDSVLEAIEKMEKNLPGFFYAGNHKGGLSVGKSIASGCKAAELVISYLENSSDDKMLKEGSSK

SEQ ID NO: 16 - protein, 509 aa, Citrus
MTNKWRVDFSGSAKRVAVVGAGVSGLAAAYKLKSNGVNVMVFEADERAGGKLRSISKDGLIWDEGANTMTESEMEVKGLLDDLGIREKQQFPISQYKRYVVRNGVPFLIPTNPIALITSNFLSAQSKFQIILEPFLWKKSDSAKVSAEDAKESVGGFFQRHFGREVVDFLIDPFVAGTSAADPESLVMRHSFPELWNLEKRYGSVIAGAIKSKFSARKEKSAEAKGSSEKKHRQRGSFSFLGGMQTLTDALCKALGKDEVCLKSKVLSLSYSHDGKSALENWSLSSSNQDKQSQGLSFDAVIMTASLCNVKEMKITKGGNLFPLDFLPEVIYMPLSVFITAFKKENVGKPLQGFGVLVPSKEQQNGLKTLGTLFSSMMFPDRAPKDLFLYTTFVGGSRNKELAKASTDELKQIVTSDLRQLLGVEGEPTFVNHFFWSKAFPLYGRDYDSVLEAIEKMEKNLPGFFYAGNHKGGLSVGKSIASGCKAAELVISYLENSSDDKMLKEGSSK

SEQ ID NO: 17 - protein, 502 aa, Cicer
MASSAKDNNSRSVKRVAVVGAGVSGLAAAYKLKSHGLDVTVFEAEGRAGGRLRTVSRDGLVWDEGANTMTENEAEVKSLIDALGLQEKQQYPLSQHKRYIVKNGMPLLVPANPAALLKSKLLSAQSKIRVIFEPFMWKRSDSSTVCDENSEESVSRFFERHFGKEVVDYLIDPFVGGTSAADPESLSMRHSFPELWNLEKRFGSIIGGALQSNLFGKRDKTGETKDAPRKSKHQRGSFSFQGGMQTLTDTLCKELGKDNLKLNAKVLTLAYSHNGSSPSENWSITCASNLTTQDVDAVIMTAPLGNVKDIQITKRGTPFTLNFFPEVTYLPLSVLITTFKKENVKRPLEGFGVLVPSKEEQNGFKTLGTLFSSMMFPDRAPSDLHLYTTFIGGTRNRELAQASTDELKKIVTSDLRKLLGAEGEPTFVNHFYWSKGFPLYGHNYGLVLEAIDKMEKGLPGFFYAGNHRGGLSVGRAIASGCKAADLVISYLNNASDNTVADK

SEQ ID NO: 18 - protein, 502 aa, Cucumis
MASPAKQDRRTSRKKVAVVGAGVSGLAAAYKLKSHGFDVTVLEADERVGGKLRSVSYKGLIWDEGANTMTESEPEVQCLLDDLGLREKQQFPISQNKRYIVRNGVPVLVPTNPIALIKSNFLSAKSKFQIILEPFLWKKYDSSKVSDDGTDESVGGFFQRHFGQEVVDYLIDPIVAGTSAGDPDSLSMSHSFPELWNIEKRFGSIFAGLVLSKLSTKKESGGVRNGTTGKSKPRRGSFSFQNGMQTLTDTLSKELGEGVLKLRSEVLSLSYNAGKYASQNWSLIYSKDKNSKDLIADAVIMTAPVCSVREMKFMKGGIPFSLNFLPEVAYMPLSVMITTFRKESVKRPLEGFGVLVPSSEQQNGLRTLGTLFSSMMFPNRASNDEYLYTTFIGGSRNRELAKSSTDELKQIVTTDLRQLLGVEGEPTFINHFYWSKAFPLYGRNYDSVVKAIETMEKNLPGFFYAGNHRDGLSVGKSIASGCKAADLVISYLESSTDQSCAE

SEQ ID NO: 19 - protein, 497 aa, Cucumis
MKSSQSSRKKVAVVGAGVSGLAAAYKLKSHGFDVTVLEADERVGGKLRSVSYKGLIWDEGANTMTESEPEVQCLLDDLGLREKQQFPISQNKRYIVRNGVPVLVPTNPIALIKSNFLSAKSKFQIILEPFLWKKYDSSKVSDDGTDESVGGFFQRHFGQEVVDYLIDPIVAGTSAGDPDSLSMSHSFPELWNIEKRFGSIFAGLVLSKLSTKKESGGVRNGTTGKSKPRRGSFSFQNGMQTLTDTLSKELGEGVLKLRSEVLSLSYNAGKYASQNWSLIYSKDKNSKDLIADAVIMTAPVCSVREMKFMKGGIPFSLNFLPEVAYMPLSVMITTFRKESVKRPLEGFGVLVPSSEQQNGLRTLGTLFSSMMFPNRASNDEYLYTTFIGGSRNRELAKSSTDELKQIVTTDLRQLLGVEGEPTFINHFYWSKAFPLYGRNYDSVVKAIETMEKNLPGFFYAGNHRDGLSVGKSIASGCKAADLVISYLESSTDQSCAE

SEQ ID NO: 20 - protein, 504 aa, Nicotiana
MAPSAGEDKHSSAKRVAVIGAGVSGLAAAYKLKIHGLNVTVFEAEGKAGGKLRSVSQDGLIWDEGANTMTESEGDVTFLIDSLGLREKQQFPLSQNKRYIARNGTPVLLPSNPIDLIKSNFLSTGSKLQMLLEPILWKNKKLSQVSDSHESVSGFFQRHFGKEVVDYLIDPFVAGTCGGDPDSLSMHHSFPELWNLEKRFGSVILGAIRSKLSPKNEKKQGPPKTSANKKRQRGSFSFLGGMQTLTDAICKDLREDELRLNSRVLELSCSCTEDSAIDSWSIISASPHKRQSEEESFDAVIMTAPLCDVKSMKIAKRGNPFLLNFIPEVDYVPLSVVITTFKRENVKYPLEGFGVLVPSKEQQHGLKTLGTLFSSMMFPDRAPNNVYLYTTFVGGSRNRELAKASRTELKEIVTSDLKQLLGAEGEPTYVNHLYWSKAFPLYGHNYDSVLDAIDKMEKNLPGLFYAGNHRGGLSVGKALSSGCNAADLVISYLESVSTDSKRHC

SEQ ID NO: 21 - protein, 501 aa, Solanum
MAPSAGEDKQKRVAVIGAGVSGLAAAYKLKVHGLNVTVFEAEGRAGGKLRSLSQDGLIWDEGANTMTESEGDVTFLLDSLGLREKQQFPLSQNKRYIARNGTPTLIPSNPFDLFKSNFLSTGSKLQMLFEPLLWKNKKLTKVSDKHESVSGFFQRHFGKEVVDYLIDPFVAGTCGGDPDSLSMHLSFPDLWNLEKRFGSVIVGAIQSKLSPIKEKKQGPPRTSINKKRQRGSFSFLGGMQTLTDAICKNLKEDELRLNSRVLELSCSCSGDSAIDSWSIFSASPHKRQAEEESFDAVIMTAPLCDVKSMKIAKRGNPFLLNFIPEVDYVPLSVVITTFKKESVKHPLEGFGVLVPSQEQKHGLKTLGTLFSSMMFPDRAPNNVYLYTTFVGGSRNRELAKASRTELKEIVTSDLKQLLGAEGEPTYVNHLCWSKAFPLYGHNYDSVLDAIDKMEKSLPGLFYAGNHKGGLSVGKALSSGCNAADLVISYLEAVSADTKNHS

SEQ ID NO: 22 - protein, 508 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMLPTNPIELVTSSVLSTQSKFQILLEPFLWKKKSSKVSDASAEESVSEFFQRHFGQEVVDYLIDPFVGGTSAADPDSLSMKHSFPDLWNVEKSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAVIMTAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 23 - protein, 512 aa, Arabidopsis
MESGAVGDHDTKFESISGKRVAVVGAGVSGLAAAYKLKSRGLNVTVFEADERAGGKLTSVMQNGLIWDQGANTMTEAEPEVGSLLDDLGLRDKQQFPISQKKRYIVRNGLPMMLPTNPIELVTSSVLSTQAKIQILLEPFLWKKNDSSSKVSDASAEESVSGFFQRHFGQEVVDYLIDPFVGGTSAADPDSLSMKHSFPDLWNVEKSFGSIIVGAIRTKLAAKGGKSGEAKSSPGTKRGSRRSFSFKGGMQILPDMLCKSLSHDEINLDSKVLSLSYNSGSRQENWSLSCVSHNETQRQNLHYDAVVMTAPLCNVKEMKVTKGGQPFLLNFLPEINYMPLSVLITTFTKEKVKRPLEGFGVLIPSKEKKHGFKTLGTLFSSMMFPDRCPSDLHLYTTFIGGSRNQELAKASTDELKQVVTSDLQRLLGVEGEPVSVNHYYWRKAFPLYDSSYGSVMEAIDKMEKDLPGFFYAGNHRGGLSIGKSIASGCKAADLVISYLESCSNDKKPDESL

SEQ ID NO: 24 - protein, 501 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMLPTNPIELVTSSVLSTQSKFQILLEPFLWKKKSSKVSDASAEESVSEFFQRHFGQEVVDYLIDPFVGGTSAADPDSLSMKHSFPDLWNSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 25 - protein, 547 aa, Arabidopsis
MGLIKNGTLYCRFGISWNFAAVFFSTYFRHCFRLVRDFDSELLQIAMASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMLPTNPIELVTSSVLSTQSKFQILLEPFLWKKKSSKVSDASAEESVSEFFQRHFGQEVVDYLIDPFVGGTSAADPDSLSMKHSFPDLWNSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 26 - protein, 467 aa, Ambrosia
GCAAAYKLKLHGLNVTVFEADERVGGKLRSVSQDGLIWDEGANTMTESEADVSSLIDDLGLRDKQQFPISQHKRYIVRNGKPVLIPSNPIALIRSSFLSTQSKVQILLEPFLWKKTKSSDEPESVGGFFQRHFGKEVVEYLIDPVVAGTSGGDPESLSMRHAFPELWDLERRFGSIISGAFQSMVSSRGGKRKPSGNSKRRRGSFSFFGGMQTLTDALSKEIGPHEINLQSKVLEMSYSCDDNAVGNWSIYCAPDQNKQFQQSFDAVIMTAPLNNLKEMKITKTGSPFLLNFIPEVSYLPISVIISTFKKENVKQPLEGFGVLVPAKEQENGLRTLGTLFSSMMFPDRASEDVYLYTTFVGGSRNKELAKASRDELKQIVTSDLRQLLGTEGEPKFLTHYYWSKAFPLYGRDYGSVIEAIEKMEKELPGYFYAGNHKGGLSVGKAISSGCKAAESVIAYLDSYSNQK

SEQ ID NO: 27 - protein, 542 aa, Setaria <grass>
MLSSSTTTASPASSHPYRPAYPRASLRPVLAMAGSDDPRAAPARSVAVIGAGVSGLAAAYRLRKSGVNVTVFEAADRAGGKIRTNSEAGFLWDEGANTMTEGELEVSRLIDDLGLQDRQQYPNSQHKRYIVKDGAPALIPADPISLMKSSVLSTKSKLALFLEPFLYKKSNTRNSGKVSDEHLSESVGSFFERHFGREVVDYLIDPFVAGTSAGDPESLSIRHAFPALWNLERKYHSIIVGAILSKLTAKGDPVKTGSDLSGKRRNRRASFSFHGGMQSLINALHNEVGDDNVKLGTEVLSLACTFDGLPSTGGWSISVDSKDAGSKDLAKNQTFDAVIMTAPLSNVQRMKFRKGGAPFVLDFLPKVNYLPLSLMVTAFKKEDVKKPLEGFGVLIPYKEQQKHGLKTLGTLFSSMMFPDRAPDDQYLYTTFVGGSHNRDLAGAPTSILKQLVTSDLKKLLGVEGQPTFVKHIYWRNAFPLYGRDYGSVLDAIEKMEKNLPGFFYAGNNKDGLAVGNVIASGSKAAELAISYLESQTKHNNSH

SEQ ID NO: 28 - protein, 544 aa, Sorghum <genus>
MLARTATVSSTSSHSHPYRPTSARSLRLRPVLAMAGSDDSRAAPARSVAVVGAGVSGLVAAYRLRKSGVNVTVFEAADRAGGKIRTNSEGGFLWDEGANTMTEGELEASRLIDDLGLQDKQQYPNSQHKRYIVKDGAPALIPSDPISLMKSSVLSTKSKIALFFEPFLYKKANTRNPGKVSDEHLSESVGSFFERHFGREVVDYLIDPFVAGTSAGDPESLSICHAFPALWNLERKYGSVVVGAILSKLTAKGDPVKTRRDSSAKRRNRRVSFSFHGGMQSLINALHNEVGDDNVKLGTEVLSLACTLDGAPAPGGWSISDDSKDASGKDLAKNQTFDAVIMTAPLSNVQRMKFTKGGAPFVLDFLPKVDYLPLSLMVTAFKKEDVKKPLEGFGVLIPYKEQQKHGLKTLGTLFSSMMFPDRAPDDQYLYTTFVGGSHNRDLAGAPTSILKQLVTSDLKKLLGVQGQPTFVKHIYWGNAFPLYGHDYNSVLEAIEKMEKNLPGFFYAGNNKDGLAVGSVIASGSKAADLAISYLESHTKHNNLH

SEQ ID NO: 29 - protein, 477 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMKKSSKVSDASAEESVSEFFQRHFGQEVVDYLIDPFVGGTSAADPDSLSMKHSFPDLWNVEKSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAVIMTAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDS

SEQ ID NO: 30 - protein, 544 aa, Zea
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANTMTEGEWEASRLIDDLGLQDKQQYPNSQHKRYIVKDGAPALIPSDPISLMKSSVLSTKSKIALFFEPFLYKKANTRNSGKVSEEHLSESVGSFCERHFGREVVDYFVDPFVAGTSAGDPESLSIRHAFPALWNLERKYGSVIVGAILSKLAAKGDPVKTRHDSSGKRRNRRVSFSFHGGMQSLINALHNEVGDDNVKLGTEVLSLACTFDGVPALGRWSISVDSKDSGDKDLASNQTFDAVIMTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNNKDGLAVGSVIASGSKAADLAISYLESHTKHNNSH

SEQ ID NO: 31 - protein, 544 aa, Zea
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANTMTEGEWEASRLIDDLGLQDKQQYPNSQHKRYIVKDGAPALIPSDPISLMKSSVLSTKSKIALFFEPFLYKKANTRNSGKVSEEHLSESVGSFCERHFGREVVDYFVDPFVAGTSAGDPESLSIRHAFPALWNLERKYGSVIVGAILSKLAAKGDPVKTRHDSSGKRRNRRVSFSFHGGMQSLINALHNEVGDDNVKLGTEVLSLACTFDGVPALGRWSISVDSKDSGDKDLASNQTFDAVIMTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNSKDGLAVGSVIASGSKAADLAISYLESHTKHNNSH

SEQ ID NO: 32 - protein, 509 aa, Lemna perpusilla
MEADAGKGSAGGAQILSHDSVRSVAVIGGGISGLAAAYKLKSNGFRAVVFEAEGKAGGKIRSGSQEGLIWDEGANTMAESVEAGELFDDVGIREKQQYPLSQSKRYVVRNGVPVMIPSDPISLIKSNLLSTKAKFRMFLEPFFSYRRVKPSKVSDEKLSESVGEFFQRHFGKEVVDYLIDPFVAGTSGGDPESLSMPHAFPEIWNLQEKYGSVILGAIQSKFLDKRKGDRTERATVKKRRPRGSFSFHGGMQTLIDVLCAKVGEENLELNSKVLSLACGHEGDPSFDSWSISVASNNGSQKDLLTKSFFDAVIMTAPLGNVEDMKFTKKGSPFALDFLPQVTYLPLSVLITSFKRENVKRPLEGFGVLVPSKEQEGGFKTLGTLFSSAMFPDRAPSDQYLYTTFIGGSRNRDLAGASLEELKQIVLSDLHKLLGVVGEPSFIKHVYWSKAFPLYGRDYGLVMEAIDRMERNLPGFYYAGNHRDGLSVGKAIASGFRAADLAISYINSSV

SEQ ID NO: 33 - protein, 544 aa, Lemna perpusilla
MASSAAISPLHFSPAPPRRRELSHRCRVRCSIAGKPPATAANDSSATSVTGGEPVRRLRADCVIVGAGISGLCTAQALTVRPAAGRSSAPDVLVTEARDRVGGNITTVERDGYLWEEGPNSFQPSDAVLTMAVDSGLKDDLVLGDPDAPRFVLWKGKLRPVPAKPTDLPFFDLMSIGGKIRAGFGALGLRPSPPSREESVEEFVRRNLGDEVFERLIEPFCSGVYAGDPSKLSMKAAFGKVWKLEQTGGSIIGGTFKAIQERSKNPKPPRDPRLPTPKGQTVGSFSKGLAMLPNAIASRLGDKVKLSWKLSGIKKSENGGYALTYDTPEGLTSVNADCVVLTIPSYVAGDLLRPLSNEAADALTKFYYPPVAAVTISYPSDSIRSECLIDGQLKGFGQLHPRSQGVETLGTIYSSSLFPNRAPPGRVLLLNYIGGSTNTAIVSKTESELVEAVDRDLRKMLVKVNAADPAVQGVRVWPRAIPQFLIGHTDLLDAATRSLDRAGYGGLILGGNYVAGVALGRCIEGAYDTAAKVNSFLSKYARSF

SEQ ID NO: 34 - protein, 482 aa, Populus
MTAAAKDDDFGSKQSKNVAVIGAGVSGLAAAYKLKSNGVKVTVFEAEGRAGGKLRSVSHHDLVWDEGANTMTESEVEVKSLLDDLGLREKQQFPIAQNKRYIVRNGMPVLIPTNPVALIKSNFLSAQSKLQIILEPFLWKKNESSKVSDADIQESVGEFFQRHFGKEVVDYLIDPFVAGTSAGDPESLSARHNFPDLWNLEKRFGSIIAGAVKAKLSAKKEKNGEKKGSSEKKKRQHGSFSFLGGMQTLTDTLCTELGKDGVKLESKVLSLSYSYDGKSTFENWSVSYASKGGKHAQASSYDAVIMTAPLCNVKEININKGRNRFSLDFLPQMSYMPLSVIITTFKKEDVKRPLEGFGVLVPSKEQQNGLKTLGTLFSSMMFPDRAPKDSYLYTTFVASTVLDCSHYYWSKAFPLYGKNYDLVLEGIERMEKNLPGFFYAGNHRGGLSVGKAIASGCKAADLVISHLNSSADDKMLKKGSQS

SEQ ID NO: 35 - protein, 569 aa, Capsella <angiosperm>
MHDAGDSHDPFEIHKHVDVELKSGLDAKTLNKGPLDKRLKIIGPEELKTRFDAELSWLLLITMASAKVADNDTKFEAVSGRRVAVVGGGVSGLAAAYKLKSKGLNVTVFEADGRAGGKLRSVMHNGLIWDEGANTMTEAEPEVGTLLDDLGLREKQQFPISQKKRYIVRNGVPVMIPTNPIDLVTSTVLSTQSKFEILLEPFLWKKNDLSSKVSDASAAESVSGFFRRHFGQEVVDYLIDPFVGGTSAADPDSLSIVFVYCLILLILISLPTIHDQMKHSFPDLWNVEKSFGSVIVGAIRTKLAAKGVQILPDMLCKGLSHDELNLDSKVLSLSYNSGSRQENWSLSCVSHNEMQRQNLHYDAVIMTAPLCNVKEMDVMKGGQPFQLNFLPEIKYMPLSVIITTFTKEKVKRPLEGFGVLIPSKEQKHGFKTLGTLFSSMMFPDRCPSDLHLYTTFIGGSRNQELAKASTDELKQVVTSDLQRLLGVEGEPEFVNHYYWRKAFPLYDSSYDSVMEAIDKMEKDLPGFFYAGNHRGGLSVGKSIASGCKAADLVISYLESCSNDKKPEDS

SEQ ID NO: 36 - protein, 544 aa, Brachypodium
MLTSATASPSASTRFSSTCRPCRSDSVPARRPRPVLAMAASDDPRAAPARSVAVVGAGVSGLVAAHRLRKSGVRVTVFEADDRAGGKIRTNSDSGFLWDEGANTMTESALEASRLIDDLGLQDKQQYPNSQHKRYTVKDGAPTLIPSDPIALMKSTVLSTKSKFKLFLEPFLYEKSHTRNSQKVSDNHLSESVGSFFERHFGKEVVDYLIDPFVAGTSAGDPESLSIRHAFPGLWDLEKKYGSIIVGAILSKLTAKGDSTKKADTSSGKGRNKQASFSFHGGMQTLVEGLHKDVGDGNVKLGTQVLSLACSCDRLSASDGWSISVNSKDASSKLAAKNQLFDAVIMTAPLSNVQRMKFTKGGVPFVLDFLPKVDYLPLSLMVTAFRKEDVKRPLEGFGVLIPYKEQQKYGLKTLGTLFSSMMFPDRAPNDQHLFTTFVGGSHNRDLAAAPTAILKQLVTSDLRKLLGVEGQPTFVKHVHWKNAFPLYGHDYDLALEAIGKMENELPGFFYAGNNKDGLAVGNVIASGSKTADLVISYLESHQAR

SEQ ID NO: 37 - protein, 506 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVIFLCICRDNQVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 38 - protein, 494 aa, Picea
MAEHIHTDQNDKRPLKSVAVVGAGISGLAAAYRLKSQGLAVTIFEADGTTGGKIKSFAQNGLIWEKGANTMTETEPEVGKLIDDLGIRGKQQFPIMQSKRYIVRDGKPQLLPSNPVAFIGSKTLSAQAKLNIFLEPILWKHKNSKEKTPNSPDIYQEESVGDFFRRHFGQEVVDYIVDPFVAGTAGADAESLSIRHMFPEIWDLEERFGSIITGAIKSSWSRKKAQRDAKHVTHGQKRQRGSFSFMGGLQTLTNALSKKLGEESLRMHCSVLSLSCNLQGNPPHNNWSVCYARNDASYKEPLKEQSFDAVVMTVTYLPMSIIITTFKKQDVKHPLEGFGILVPSKEEKNGFQTLGTLFSSNMFPDRAPTDQYLFTTFIGGNRNRKLAKSQLKDLQEVAVNDLNKILGVGSDPLSVKHIYWNEAFPLYSLDYNSVVAAIDKLGKSLPGIYFAGNYRGGLSVGKALTSGFKAADLAISDFNSKGLCTMIGTDHEVK

SEQ ID NO: 39 - protein, 404 aa, Solanum
MAPSAGEDKQNCPKRVAVIGAGVSGLAAAYKLKIHGLNVTVFEAEGRAGGKLRSLSQDGLIWDEGANTMTESEGDVTFLLDSLGLREKQQFPLSQNKRYIARNGTPTLIPSNPIDLIKSNFLSTGSKLQMLFEPLLWKNNKLTKVSDEHESVSGFFQRHFGKEVVDYLIDPFVAGTCGGDPDSLSMHLSFPELWNLEKRFGSVIVGAIRSKLSPIKEKKQGPPKTSVNKKRQRGSFSFLGGMQTLTDAICKDLKEDELRLNSRVLELSCSCSGDSAIDSWSIFSASPHKRQAEEESFDAVIMTAPLCDVKSMKIAKRGNPFLLNFIPEVDYVPLSVVITTFKKESVKHPLEGFGVLVPSQEQKHGLKTLGTLFSSMMFPDRAPNNVYLYTTFVGGSRNRELAKA

SEQ ID NO: 40 - protein, 549 aa, Oryza
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESMFSDQREYICSVIFLCICRDNQVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGKSMKAPLLYKRNLRYLKHIPVD

SEQ ID NO: 41 - protein, 549 aa, Oryza
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESMFSDQREYICSVIFLCICRDNQVVDYLIDPFVAGTSGGDPESLSIRHAFPALWNLENKYGSVIAGAILSKLSTKGDSVKTGGASPGKGRDKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGKSMKAPLLYKRNLRYLKHIPVD

SEQ ID NO: 42 - protein, 405 aa, Eutrema
MAPDAVADHDKKFEALSGKRVAVVGAGVRLKSRGLNVTVFEADGRAGGKLRSVMHKGLIWDEGANTMTEAEPEVGSLLDDLGLREKQQFPISQKKRYIVRNGLPVMIPTNPIALVTSSVLSTHSKFQILLEPFLWKKNDSSSKVSDASTVESVSGFFQRHFGQEVVDYLIDPFVGGTSAADPDSLSMKHTFPDLWNIEKSFGSIIVGAIRTKFAAKGGKSGETRTSPGTKKGSRGSFSFKGGMQILPDMLCKDLSHDELNLDSKVLSLSYNSGSRQENWSLSCVSHNETLRQNLHYDAVVMTAPLCNVKEMKVVKGGQPFQLNFIPEIKYMPLSVIITTFTKEKVKRPLEGFGVLIPSKEEKHGFKTLGTLFSSMMFPDRCPSDLHLYTTFVGGSRNQELAKAST

SEQ ID NO: 43 - protein, 520 aa, Selaginella
MAMAEGETAPVLGSVAVVGAGASGLAAAYRLRAAGVSVTVYEAENSIGGKLKSVSENGFIWEKGPNTMTENDPSISRMFDDLHLRDKQQFPVEQKKRYIVRNASPTMLPSNPLGFITTGLFSAQAKLKLLTEPFSWKRTKAESNEDESVGAFMERHFGDEIVDYAVDPFVAGTSGSDPSSISIRHSFPELWSLEKNYGSLFVGAIKSGFSKKKKQKLRPVEFEDEDSDFPARTRPRRGGSFSFVGGMQTLANELVSRIGKEKFKLNTFVTGLACNQQGNPSRQSWTVTGLETSGKRSKRSDKTFDAVIMTAPVDDVRAMKVVKDGKPYALDYLPTVIYEPMSVLITMFNKDSVKRALPGFGVLVPSKEQQANGFQTLGTLFSSFMFPDRAPEDQLLFTTFIGGSRNTLLASRSKEELLDITLKDLSRLIGVEGQPTAIRHVYWEKAFPRYSIGYDNVLHSIQKLESDLPGLFYAGNHRGGLAVGKTIVSGLDAAEQVLQYLQGSGGKKVFTMASLEQPVS

SEQ ID NO: 44 - protein, 514 aa, Selaginella
MAMAEGETVPVLGSVAVVGAGASGLAAAYRLRAAGVSVTVYEAENSIGGKLKSVSENGFIWEKGPNTMTENDPSISRMFDDLHLRDKQQFPVEQKKRYIVRNASPTMLPSNPLGFITTGLFSAQAKLKLLTEPFSWKRTKAESNEDESVGAFMERHFGDEIVDYAVDPFVAGTSGSDPSSISIRHSFPELWSLEKNYGSLFVGAIKSGFSKKKKQKLRPVEFEDEDSDFPARTRPRRGGSFSFVGGMQTLANELVSRIGKEKFKLNTFVTGLACNQQGNPSRQSWTVTGLETSGKRSKRSDKTFDAVIMTAPVDDVRTMKVVKDGKPYALDYLPTVIYEPMSVLITMFNKDSVKRALPGFGVLVPSKEQQANGFQTLGTLFSSFMFPDRAPEDQLLFTTFIGGSRNTLLASRSKEELLDVTLKDLSRLIGVEGQPTAMRHVYWEKAFPRYSIGYDNVLNSIQKLESDLPGLFYAGNHRGGLAVGKTIVSGLDAAEQVLQYLQGSGGKKVFTMAS

SEQ ID NO: 45 - protein, 230 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEK

SEQ ID NO: 46 - protein, 229 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGDPQSLSMHHTFPEVWNIEK

SEQ ID NO: 47 - protein, 396 aa, Zea
MKSSVLSTKSKIALFFEPFLYKKANTRNSGKVSEEHLSESVGSFCERHFGREVVDYFVDPFVAGTSAGDPESLSIRHAFPALWNLERKYGSVIVGAILSKLAAKGDPVKTRHDSSGKRRNRRVSFSFHGGMQSLINALHNEVGDDNVKLGTEVLSLACTFDGVPALGRWSISVDSKDSGDKDLASNQTFDAVIMTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNNKDGLAVGSVIASGSKAADLAISYLESHTKHNNSH

SEQ ID NO: 48 - protein, 414 aa, Aegilops
MTESALEASRLIDDLGLEDRLQYPNSQHKRYTVKDGAPALFKLFLEPFLYEKSSTRNSKKVSDEHLRESVGSFFERHFGREVVDYLIDPFVAGTSAGDPESLSIRHAFPGLWNLEKKYGSLIVGAILSKLTAKGDSSKKGGASSGKGRSKRASFSFHGGMQTLVDALHKEVGDSNVKLGTQVLSLACNCDELSASDGWSIFVDSKDASSKELAKNQSFDAVIMTAPLSNVQRMRFTKGGAPFVLDFLPKVDYLPLSLMVTAFKKEDVKRPLEGFGVLIPFKEQQKHGLKTLGTLFSSMMFPDRAPNDQYLFTTFIGGSHNRDLAGAPTAILKQFVTSDLTKLLGVVGQPTFVKHIHWRNAFPLYGHDYDSALEAIGKMERNNKDGLAVGNVIASGSNTADLVISYLESGIKQVS

SEQ ID NO: 49 - protein, 304 aa, Genlisea
GFPAKNVAVIGAGVSGLSAAYKLKLNGLNVTVFEADGRAGGKIRTSSQDSLIWDEGANTMTESEEEVGFLLDNLGLREKQQFPLSQQKRYVVKNGKPALLPSNPFALIASNILSSSSKLQIFLEPFLWKQRNSEETQAEESVGGFFQRHFGKEVVDYLVDPFVAGTSGGDPESLSMRHAFPDLWNLEKRFGSVMSGAVLSKLSAGRGASEKNKGSSTNERRKRKSFSFIGGMQTLTDALSNEIGENELKLRSKVLGLSSNNVKSSKVDSWSISYASSDGKSVSLDTGFDAVIMTAPLSDVKQMK

SEQ ID NO: 50 - protein, 265 aa, Amborella
MSSKGEEKGKHEATRRKPKHQRGSFSFQGGLQTLTDKLAEELGNENVKLHSKVLSLSYGDGNGDSFSNWSVSYIKNQSDQRKLLLKQSFDAVVMTAPIRNMQEMQISKCGKPYMLDFLPNVMYLPLSIIVTTFKKENVKLPLEGFGVLVPSKEQGSGLRTLGTLFSSMMFPDRAPKDQYLYTTFVGGSRNRNLASASLDELREVVTCDLKKLLGVVGAPTFVRHVYWGDAFPLYGHNYDMVLKAIEKMEQNLPGFFYAGKFSLWC

SEQ ID NO: 51 - protein, 469 aa, Rhodothermus
MASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 52 - protein, 461 aa, Salinibacter
MPNVGIIGAGISGLAAAYRLQEHGHSVRLLEASGHTGGVIRSESSEGFLVEHGPNSIRAGAAGLETLIDALDLHEDRVWANDAADTRYVVRDGRPTPLPRSVGSFLTTDLFSTRAKLRLLAEPFIGRAAAEEESVARFTERRLGPEVLNYAVAPFVGGVFAGRPDDLSVQHAFRRLAALEEESGSLLLGAIRRALTSDDGAPPDTPSGLFSFRNGLQTLPNALADTLGDRIRLNAPVHALAHDGTAWRVTVSPPDAPAHTRSFDALVCTVPLHRLAAMEIDTPVDLAPLGEVTYPPLSVLALGYGRDAIDHALDGFGMLVPPVEDTLDVLGTIFSSTLFPGRAPEGHVLLTTFVGGARAPHHATSDAAALQARVARDLDSLLGVDASPVFRRLVHWPHAIPQYELGYGTVKDTFDALEAAHPHLAFAGNYRAGVSVGDALTSGLEAADRLLETDERAAQPH

SEQ ID NO: 53 - protein, 461 aa, Salinibacter
MPNVGIIGAGISGLAAAYRLQEHGHSVRVLEASGHTGGVIRSESSEGFLVEHGPNSIRAGAAGLETLIDALDLHEDRVWANDAADTRYVVRDGRPTPLPRSVGSFLTTDLFSTRAKLRLLAEPFIGRAAAEDESVARFTERRLGPEVLNYAVAPFVGGVFAGRPDDLSVQHAFRRLAALEEESGSLLLGAIRRALTSDDGAPPDTPSGLFSFRNGLQTLPNALADTLGDRIRLNAPVHALTHDGTAWRVTVSPPDAPAHTRSFDALVCTVPLHRLAAMEIDTPVDLAPLGEVTYPPLSVLALGYERDAIDHALDGFGMLVPPVEDTLDVLGTIFSSTLFPGRAPEGHVLLTTFVGGARAPHHATSDAAALQARVARDLDSLLGVDASPVFRRLVHWPHAIPQYELGYGTVKDTFDALEAAHPHLAFAGNYRAGVSVGDALTSGLEAADRLLETDERATQPH

SEQ ID NO: 54 - protein, 203 aa, Zea
MTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNNKDGLAVGSVIASGSKAADLAISYLESHTKHNNSH

SEQ ID NO: 55 - protein, 469 aa, Rhodothermus
MASVGIIGAGIAGLAAAYELHRRGLEVTVFEATDRIGGFIQSERIDGFLVEHGPQTLQRTSGDFEELLRQVDLEDACITARPIAANRFIVRGGRPIPLPRSPRELLRTPLLSPRARLRLLAEPFIHRAHRSTEESVAKFARRRLGPEVLDYLVEPFVAGIFAGDPEQLSVRYAFPKLFELEQQYGSLFWGLIRDRMKQRYHPAPRRSMFSFVEGLHMLPRALADRLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 56 - protein, 453 aa, Caldithrix
MTVAVIGAGISGLTTAYYLKQQGVDVQVFEKNNYIGGSVITEKKDGFLIDLGPNSTLETSQVLRQLIDQIGLQSQKVYASDVSNKRYVVRDGLLHALPLSPPAFIKTKLFSWKAKLQLLKEPFLPKVEVDDISLADYVRYRLGDEFLDYAINPFVAGVYAGDPEQLSAPAAFPKLYNLEQNYGSFIKGAIKGKRERKKRQEVAKDRAKMFSFLDGMQVFPQALARQLGEVIHLNCEVREVIPHGKGFKVVLEQDSGEQECFFERVVISVPTYVQAKILNSILKERAALLADVLHPPIAVVFMGFKRDDVAHALDGFGFLLPAKEKKQILGSIFSSTIFPQRAPQGKVAFTTFVGGMRNPDNALKDDEEIKELVLKDLNDLVGLHGQPVLTRIRRWPRAIPQYTLGYKKIQALFDELEQEFSGLFFAGNFRRGISVGDSVLSAFETSEKMLKEK

SEQ ID NO: 57 - protein, 467 aa, Opitutus
MSTSPFNPSATASGRPPKTFAVLGAGITGLTAAHRLTQLGHKVRVFEQSDRVGGSIKTEEVDGWLIEGGPNTLLSGELAVDKLIDELGLNGERIAADPAAKNRYIVRRGRALAAPMSPPSFFASSLFSPVAKFKLLAELFARRRVRTTDVSLAEFVESHFGREFVDYALNPFVGGVYAGDPEKLSARQSFPKLWEIEQTHGSLIRGQIAAAKARKARGEPRPGIFSFKHGLHVLPEALAARLPAGAITLGASLDAIVPGDKWNVVWHDDVATHTQSFDSVVVALPAPALARLQIGTLGEKPLAALALIEHPPVSSLFLGFRREQVAHPLDGFGVLVPAVEKRSVLGVLFSSSLFPGRAPLGHVALTVMVGGTRQPQLASLPADQLLAAVRPDLTQLLGVSGDPVFVRHNFWPRAIPQYNLGHEHFIAALAAGERFHPGLFMGGQARDGIAVPACIAAGEKLAERAGQ

SEQ ID NO: 58 - protein, 455 aa, Verrucomicrobia
MGNPNKTIAILGGGITGLTAAYELLKLGHKPTVFESSSRIGGAIETIRQNDFLAECGPNTLLETSPRISALISDLGLDSRKRYANPSMKNRYIIKGGKPVPMPLSPGQFVTTKLFSLGAKLNLIKEPFIAPCPSETEESLAAFVVRRLGQEFLDYAINPFVAGVYAGDPSKLSVQHAFPKLYALEQQYGSMIKGQFFGARERKKRGTVSKDKAKLVSFDQGLEVLVDGLGQKIEDTINISTVIESVEKAEEKWVVQGRKIRESFDAVITAIPTHRMTKMTFRDESDLDMSILRDIIYPPVSSVVMGFRRDQIQHSLEGFGMLVPKVERKNILGTIFSSSLFENRAPEGYVTLSTYIGGMRQPDHALLDDQEMDRLILKDLEALLGVRGEPAFINRRVWKKAIPQYTVGYGKILDRFNELEAAHSGLFFAGHYRNGISLGDSILAGLDVAQRINQQ

SEQ ID NO: 59 - protein, 462 aa, Ignavibacterium
MTKTIVVIGAGISGLTTAYLLSKRGFNIRILERKSEVGGSIESIKENGFLFDRGPNSALETTPLISQLVEELNLKDELLYANKAANKRYILRNNELHALPMSPPALIKTKLFSAKAKLRLLTEPFIGRSEDGYYQSLAEFVRRRLGQEFLDYAINPFVAGVYAGKPEELSVKSAFPKLYALEEKFGGLIIGTIRSIRERKKRAEKSKQSARMLSFKSGMISLPKAIANYFADKLILSAEVISVDKTAEGFIVSYRHSGIDEAIVCDAVLSTVPSYVAGNLFSKFDKKFKVHSDEIYYPPVLVYFLAYEKKNIGQTLDGFGFLIPEKENKSFLGALWSSVIFPYRADNNFATFTLFIGGSRYPDFVKEDRNKLLEKVRKEFEQLMKIKSDPVFSAYRFWEKAIPQYNIGYIEHERFFDEFEKQNPGLFISGNFRGGISVGDCIKNAELVANKICVQFTMHNVQ

SEQ ID NO: 60 - protein, 457 aa, Coraliomargarita
MEKKAIVIGAGISGLCAAIELKKSGFNVTVVEKRERAGGVIGTTARDGFRAESGSNTVMVNSQKTLDFLMEIGLKDKIVNSSPAAKKRFFARYGKPQAVPMGPLQLLTTRLFSFAGKLRMLCEPFIKPPSQDSDPSVADFTAERFGREVLDYAMNPFMAGIYGADPEKLSIKHAFPPFWNLAIKYGSVIKGAMKARREKMAAGNFFKPVMISFKSGMHTLTDALAAELGDSVKCGAKVISIDSNCDGWEVSWGTETEDVCENYDALVVAVPAPEISGLPFGGMLAAALAPLAKIQYAPVATYTMGFKRQDVSHPLDGFGVLTPKKENFSILGSLFVSTLFDDRAPDGYIALTNYVGGMRHPEFAALERGEMRKLVLEDLKKLLGVNGEPVFEELFVWKNAIAQYNVGYQEYLDIMDDIEKRIPNIALVGAYRGGVGVSSCLENGLLSAAKLAGRISD

SEQ ID NO: 61 - protein, 465 aa, Salisaeta
MARIGIIGAGIAGLTAAYQLQQQGHMVRVWEARGVAGGAIRSERTSDGFLVEHGPNSLRATTPIVPRLLEDLGLERARLSAAPAATKRFIVRDGTLRPLPLSPPALLTTSLLSTRAKLRLLREPFVAAGAPTADETVASFVRRRLGPEVLAYAVDPFVAGIFAGDPHRLSLKHAFGRLYEMERTHGSLLRAALHSARTGATDDASTATDRRIFSLRDGLQMLPHALADALGEAIRYEAPVTALRQMPDGTWTVATETDATQVNALISTVPLHALGSIDWAPAVDTSPLQRVPYPPVRVVALGFRRADVAHPLDGFGMLVPSAEDQFQILGTLVSSTLFPGRAPAGHVLLTTFVGGMRHPTLGAASDAAVRKVVLNDLQALLGVQGAPVFERFIAWPRAIPQYTLNHGAAVRTLEQLEDVHPGLFFAGNYRDGISVGDAMASGEDAARRVDAHLAGADRAVAATGP

SEQ ID NO: 62 - protein, 179 aa, Ambrosia
MASPTIVDNQKPAKRVAIVGAGVSGCAAAYKLKLHGLNVTVFEADERVGGKPRSVSQDGLIWDEGANTMTESEADASSLIDELGLRDKQQFPISQHKRYIVRNGKPVLIPSNPIALIRSSFLSTQSKVQILLEPFLWKKTKSSDEPESVGGFFQRHFGKEVVEYLIDPVVAGTSGGDPK

SEQ ID NO: 63 - protein, 451 aa, Melioribacter
MSKKIVVLGAGISGLSTAYWLVKKGYDVTILETKNEPGGSMISRRLDNFLIDYGPNSGLETTPLIRKLVEEVNLSDKMIYANAAASKRYILKNGELIPLPMSPGSFIRTKLFSSGAKFRLMAEPFVSKSDDGYYQSIAEFVRRRLGNEFLDYAIDPFVSGVFAGDPEKLSVKSAFPKLYRLEEVYGGLIKGMIKGARERKQRNEESKQSAKMFSFLEGMQSLPNAIADKLKDNIVFSAKVLNVTGANDKQWKVTYELNGNRESITADTVISTLPAYIAAGVFGELDQKLAERLNSIYYPPVMVLYLGYNKKDIKRKLDGFGFLIPSKEKKHFLGAIWSSSIFPGRSPEDMAAFTLFVGGARSPQLFEMEKSDLIKKVLSEFHQIMNIKGEPVLIENKLWQKAIPQYNLGYIEHEKYFEVFEENHRGIYLRGNYRGGISVGDCIKNSELEIK

SEQ ID NO: 64 - protein, 472 aa, Halothiobacillus
MNTHSNASEPINCPYLVIGGGISGLATAYHLSRMGKTVTVLEATSRVGGAVGSIEEDGWLRELGPNSLVQTPEMAALMSALDLVSEIIEANTVAKKRFVAKNGHPVALPGSPLELLTSPLFSMGDLWHLAREAWIKPVNKEETIAEFVRRRLGQGFLDWAVDPFVSGVYAGDPNRLSVQAAIPKIYAFEQESGSLIRGGIAKMKAAKANPAPVTLPAKGKLFSFKRGLQTLTDALATAITSSGRGNIQLDSAITNIQRLPEGGWSVKTVQGKTFHTRQLILSTPAHVSAQLLGEVDGPLAETLAAIEYPPVTSVVMGFDRSEVAHPLDGFGLLLPSKEKKRTLGVLFSSTLFPDRTPAGKVLLSAFIGGRKHPEAAQGDDQELLDRVLGDLSPLLGIKGKPEFLRVKRWQQAIPQYEIGYLELQEKISQRLTALPGLSLNGNWRGGIAVGDCLNNGNKLAERLIENTRTEES

SEQ ID NO: 65 - protein, 480 aa, Chondrus
MPEPVKRNVAVLGGGPAGLSAAFRLLHDLPPGLSVKVDLYEATGRLGGAVTSACDAGFCYELGPNSMNAKHPSVADLIQEKLRLKPRMLPRSPYAKRYYFMRDGKLVPLPLSPLHFATTGLLSWRAKWHVVKEPFVARLQDVRDSHMESVASFFQRRFGREVVDYLVDPMVAGTYSGKPADLSMKHALRKVWRLEQKHGSVIGALLRGAGKTKPDPRYKPYTGKELRASFTYDKGMEVVTDALVANINDLNPRGGRLYTHGKVRTLDRDPNGAWRINGRGKYDAVISTIPTHAVKSIYTNMSALGKGFKKLNKSIKYAPVSVVVMGFDKSQVPHPLDGFGALIPTVEGRQILGINFSSSNYPQRLSDPDKVFLTVYVGGQRNPDLPFRRAKEIVDISKKELGHVLGVKGDPFFSRVKTWKRGIPQYDPQFDESLCTMARAEKSAKGFVFGGNYRDGVGLPDALRSGILSAEKTLQYLKTL

SEQ ID NO: 66 - protein, 463 aa, Rubritalea
MRKHIAIIGAGVSGLSTAYHLQQAGHSVVVFESSKRAGGVIQTIREDDYLCEWGPNSLMIGDKRIEALLKSIGLDDEILEANTASKKRFIIDRDRLQALPNGPFQLLGSPIFSLKAKLRLLKEPWVKRHPANSKETLADFMERRLGPEPVAKLVNPFISGIYAGDPKRLAVEHAFPKLFQLEQDYGSLIWGMIRSKKDQKNSFKSKHKLQKRRIVSFKQGMEALPQAMAAALDEGTLIFEAKIGGISQNRNNKRWHMDWKCPNGTIGQGSFDAVILTQASHHLNDIPLDEEVLESLSKLPSIDHAPVTSMLLGFKREQIKHPLDGFGMLSTFEQKSKMLGALFTSSLFPGRAPEGHVAINVMIGGVRRPELCELPEPTLRANILDELRRLLGVDGKPSFCHIHHTSKAIPQLHTDYGIVAQQIIDCEREHPGLYLAGSYRNGIALPDRLLEGISLTEKINQSL

SEQ ID NO: 67 - protein, 457 aa, Acidobacteria <phylum>
MGVEVAIIGAGISGLSVAFFLKRAGAGVLVLEAEEDVGGTMRSRRFKGYLIELGPNSALETTPLFQELIAAAGLAGERVYASEAARNRYIVRGGELHPLPLTPLAFLRSRLWSWKGKLRVLAEPFHGRADREESVADFARRRVGQEFLDYAVNPFVAGIYAGDPERLSVRFAFPRLYALEAQYGGLFLGMLRGARERRRRGEAPKIAARLFSFREGMGALPRALAAALGNTVWCATRALCVERAGAAFEIAFERDGRRDTLRAERVVLATPAYAAASLLKRLAPEAARALDRIVYPPVSAVILGYPETAIGRPLDGFGFLVPEKEQRRILGTIWNSTIFPARAPQGFVTLTTFVGGMRQPELARRPNEELIALVAEELTDLLRLRGEPEFAYVSRWERAIPQYELGYGEILDALDRAEREHVGLYFCANYRGGIAVGDCVMSAHATAERILRDRARS

SEQ ID NO: 68 - protein, 441 aa, Coraliomargarita
MPDTCIIGAGITGLATAWQYQRKGKDCVVLESGPQVGGAIQSILQDGYLAEEGPNSIQLNSLEIEDFLTSIPGLEAQIIEANPAAQKRYIVRKGRLRAVPMNPLQAITTQLWSIAGKLRVLREPFIKAAPPEPDQSVADFVTRRLGKELYDYAINPLVGGIYAGKPEMLSLRYGFPKLYALEQEHGGLIRGALAKMKAAKANKGPKAKKYILSFKDGLQTLPQSIANNLNEPVQTGVSIESIRQIEDMWAVRWNGQVKAFKELIVTVPAHKLPGLPFEEPIRLPAIDYPPVSVISLGYPLSAIKQPLDGFGALVPEREDRNILGVLFPSAVFDGRAPEGHGLLTVFVGGSRSPECSSPDTDQLLKTIQPDLETLLGIQDEPSFVHHKHWPMAIPQYTLGYEKVLEAITRIEQQYIGLKLAGNYRTGISLSYCLESAIASTN

SEQ ID NO: 69 - protein, 474 aa, Oscillochloris
MNSYDVVVVGAGISGLSAAYTLFKRGLDVLVVEAGAEVGGVMRSIVTPEGYVLDCGPNTLASKDPRMWAEFDDLGMRDRLVVAGRAGKRRYFLKDGQPLEIPNDPIGLLRMEHVSMQAKLRVLREPFIPRATSPDESVASFFSRRIGPEVMERMIDPFVSGVYSGDPSKMSIKATFPSLWEAEQRGGSIIKGFLTAGKAKKAAGEKKAKPIGPKMRSVTFNFKGGVAEWPKTIAKVLGDQRVWKNARVTTLYPESTGWTLVVERDGQVETIEAASVIMAAPAYAAADLIAELDPAAAKGLRGIRYSSMAVVNLGYRENQVTRPVNGFGVLAPSCERRNFLGILSASTLFPPFAPAGRVLTINLMGGEINPIRPEQSDDELIARAIADNQAVIGANGAPEVVNLTRWPRAVAQYNFGHTEAMAALENLERTRPGIYFVGSYRGGVGMPKCWRNGVNMAERVATYLKTRSAVASLR

SEQ ID NO: 70 - protein, 474 aa, Opitutaceae
MPVAVIGGGITGLTAAWRLAREGHPVRLFEASPRPGGLIRSERDGEWLSEAGPNSLLDNKPELAALLAELGLEDARQYAQPAAKKRFIVRRGRPLAAPSSPVSAVTTPLLSLRGKLRIFGDLFWRPRPRAEDLPLGEFAAAHFGRELADYAVDPFVSGIYAGDPQRLSARYAFPLLWELEQKHGSLIRGGIAAAKARRATRPAGPAEKPRPPRARIFSFAEGLETIPAALAERLPAGCVETGARVVRLVPPVARGGAWEVVWERKDEKDEKGASGVEGRLTERVAAVILALPGEALARLEIGANGEHPLAALAEVEYPPVASLFIGYRREQARHPLDGFGMLAPSKENRNLLGVLFSSTLFPGRAPAGHIALTVLAGGVRRPELARMELPSLMGIVRAELLELLGVSGDPVYVKHRVTPHAIPQYNLGYGRFHTVIETAETAHPGLLVGGPVRDGIAVSACVAAGEKLARRVVA

SEQ ID NO: 71 - protein, 239 aa, Amborella
STKSVAVVGGGVSGLTTAYRLKSHGLNVTLYESEGTAGGRIRSIAYGGLIWEEGANTMTESEMEVKRLIDDLGLREKQQFPISQNKRFIARNGTPVLIPSNPLALFGSKLLSPHSKLRVILEPLFWRSSNRKGDISKVSDQNLQESVGDFFQRHFGQEVVDYLVDPFVAGTSAADPNSLSVQVTSMSEICQNYLQYLGWSQGPSSQLMTLTLSPSSVIDQMLSERMVTFLQVMLSPLLM

SEQ ID NO: 72 - protein, 490 aa, Opitutaceae
MSASLPPPPPPPHTHTQARLPVAVIGGGITGLTAAWRLAREGHPVRLFEASPRPGGLIRSERDGEWLSEAGPNSLLDNKPELAALLAELGLEEARQYAQPAAKKRFIVRRGRPLAAPSSPVSAVTTPLLSLRGKLRIFGDLFWRPRPRAEDLPLGEFAAAHFGRELADYAVDPFVSGIYAGDPQRLSARYAFPLLWELEQKHGSLIRGGIAAAKARRATRPAGPAEKPRPPRARIFSFAEGLETIPAALAERLPAGCVETGARVVRLVPPVARGGAWEVVWERKDEKGASGVEGRLTERVAAVILALPGEALARLEIGANGEHPLAALAEVEYPPVASLFLGYRREQVRHPLDGFGMLAPSKENRNLLGVLFSSTLFPGRAPAGHIALTVLAGGVQRPELARMELPSLMGIVRAELLELLGVSGDPVYVKHRVTPHAIPQYNLGYGRFHTVIEAAETAHPGLLVGGPVRDGIAVSACVAAGEKLARRVVA

SEQ ID NO: 73 - protein, 474 aa, Chloroflexus
MMAGYDSVVIGGGIAGLAAAYTLHKRGYRVLVIESTNRVGGVIQTITTPEGYILDCGPNTVGTGDARLWQELIDLGLRERITPAAPCSKRRFILINGTPVEIPTSPVGLITTRLLSWRGKLRVLAEPFINRGSTDPDESVAAFFTRRIGAEATAHLLDPFVAGVYAGDPQRLSTAAVFPSLWEAAQRSGSIVRGMLSKPKPKTQVSEPKMRSRTFTFRGGLAEWPRALAQALGAGNVWTERRVVKLQPRDSWWEVTIDGVNGPETLISRSLIIATPAFTAADLIESVDQRAAGALRGIPYAPVAVVHLGFRRDQISQELSGFGVLAPSSEQRQFLGILWTSSIFPHVAPHDHVLTTTLSGGAIRPELAERSDETLIEAAIRDHHQLLGIRGQPIFTHVTRWRTAIAQYTFGHRERIATLVQLEQRLPTIQFAGSYRDGVGVPKTWASGVQAGERIAAALAAHGTTAVSTETASG

SEQ ID NO: 74 - protein, 462 aa, Leptospirillum
MAGFDCDTLVVGGGVSGLAAALTLKNRGVDVRLLESRGYLGGAIRTVREDGYLLEFGPNSLMVRPEDAIDTVLGDPELRARIVPASGLSKNRYVVKAGHLYPVPLSPWAFFRTPLLSWRGRRDILSEWKVPPRTGGPEETLSHFVRRRLGEEALDYFVDPFVKGVYASHPDLLSVEAAFPLLVRLEREHGGLLRGALKTFLKRRKRPSGSSPRGIFSFAGGMTDLVEAMGKRLGEDVGTNVDVIKYTRLEEGFRVALMYDETEYYMTSRRLILATSAPQAAELLEGDPDGPSSELKSIPYAPVTIAYAGFLREQVTHPLDGFGLLCPTVENRKVLGVIFSSSLFPGRAPEGKVLLTVFVGGMTGQKLAQAFDEDLERIVLKELTELLGVKGAPSFFRIHRWEKAIPQLILGHGETVRTIRKKLPSGLRLAGNYLDGISIARAFASGVRAAEELLSEDGGTPG

SEQ ID NO: 75 - protein, 462 aa, Leptospirillum
MAGFDCDTLVVGGGVSGLAAALTLKNRGVDVRLLESRGYLGGAIRTVREDGYLLEFGPNSLMVRPEDAIDTVLGDPELRARIVPASGLSKNRYVVKAGHLYPVPLSPWAFFRTPLLSWRGRRDILSEWKVPPRTGGPEETLSHFVRRRLGEEALDYFVDPFVKGVYASHPDLLSVEAAFPLLVRLEREHGGLLRGALKTFLKRRKRPSGSSPRGIFSFAGGMTDLVEAMGKRLGEDVGTNVDVIKYTRLEEGFRVALMYDETEYYMTSRRLILATSAPQAAELLEGDPDGPSSELKSIPYAPVTIAYAGFLREQVTHPLDGFGLLCPTVENRKVLGVIFSSSLFPGRAPEGKVLLTVFVGGMTGQKLAQAFDEDLERIVLKELTELLGVKGAPSFFRIHRWEKAIPQLILGHRETVRTIRKKLPSGLRLAGNYLDGISIARAFASGVRAAEELLSEDGGTPG

SEQ ID NO: 76 - protein, 446 aa, Verrucomicrobia
MNTKKVCILGAGLSGISLGLSHENKGNQVTIFEKDLRVGGVLQSIKSEGFLMDYGANTLSIRTKKTVDFLKQYEILEHAMDANQESSKRFIIRKNRIISLPQGPLSFLCSSFLSPVGKLRLCLEPFIGRKKDNGSDETMAEFVERRLGREVLDYGVNPFIGGVYAARPESLILKYAFPSLHDTELTFGSIFWGMIRGGAQPSEKISKSRLISFREGMQELPNRLAARMHNPPVLGCEIKKIEFKDDVQWCVQGEKHDGKIQKEVFDQIICTLPSHALDKIEWVGINSSHLLETLTRAYHPPLALVFQGYQQRQIKHPLDGFGFLVPEKERRKILGTLFSSTLFQNRAPENSVLLTTYIGGERNPELCDLPQNEILGHAFRENQDLLGIEGKPIFEHLKLWPKSIPIPDHTLEDRKKAASTLTLENKGLQILGAHINGAPLPNCMVL

SEQ ID NO: 77 - protein, 475 aa, Chloroflexus
MMMANYDSVVIGGGIGGLAAAYTLYKRGYRVLVIEAANRVGGVIHSITTPEGFTLDCGPNTIGTNDVRLWQELIDLGLRDRIRPAARCGRRRYILINGTPIEIPSSPVGLITTRLLSWRGKLRVLGEPFVNIGTPTGEESVAAFFSRRIGHEAVAHLLDPFVAGVYAGDPNQLSAAAVFPSLWEAVQRGGSIVRGMLRRPKQKTLISEPKMRSRTFSFQGGLADWPRAIARALGTGNVWTGRRAVGLRDLGTYWEVTVDGTGRLETITTRSVIIATPAYVAAELVEALDPAAASALRSIPYAPVSVVHLGFRRDQLSHELNGFGVLAPSSERRQFLGILWASSLFPHVAPPDRVLTITLSGGAIRPEVAEQSEEALIESAIRDNQEVLGIRGQPLLTHVTRWHHAIAQYTLGHRERIATLERLEQRRPTLQLTGSYRGGIGIPKTWASGVGAGERIAAALDAQGTTADTLEQARG

SEQ ID NO: 78 - protein, 456 aa, Desulfurobacterium
MKVAVIGAGISGLSVAFYLKKGGAEVKVFEKEKTVGGKMKTIHEDGYIIETGPNGFLDGKPYTLNLVKELGIESKLYRSSDKARKRFIYTNGRLVRLPESPIAFLASYLLSWKGKLRLVGEFLVPPKKEDIDESLSEFAKRRIGEEALEKLLDPMVAGIFAGDPDRLSLKAAFPAIYYLEKQYGGLIKGLIAKMKEAKKSGKKSGPAGPGGVLTSFKGGVKDLIDSLSEFLGDSIETEVEILGLDRIEKGWKVKYKKENEVFEETFDAIVFSTPAYITAKLLNDLNLELSKLLSEIEYSPISVVALGFEKKGLGHDLDGFGFLVPRSEKRKILGALWDSSVFPNRAPSGKALIRVMIGGARQPELALLPDEELVNIALKELRRIMKIRHYPEKIKVFKHEKGIPHYTVGHAERVEKIFRLISKYPGLYLCNNAYTGVGVNDCTKAAEEVARRILDG

SEQ ID NO: 79 - protein, 455 aa, Desulfurobacterium
MKKVAVVGAGVSGLSTAFYIEKFGGDNVSVTIFEKENVPGGKMLTVQKDGFIIETGPNGFLDNKPYTLDLVKDLKIEDRLYRSSDKARKRFVFVNGKLVRLPENPIAFLSSYVMSFKGKLRLAAEYFIPPKKDDSDESLSSFVKRRIGKEALEKLIDPMAAGIFAGDPDKLSVKAAFPAVWHLEKKYGGLIKGLLAMKKEKKDATAGPGGVLTSFKGGVKDLIDALVANIKGEIHPGTTVKKLIPENGKWKIVYEKDDEIFEESFDKVVLSTPSYVAAALVKNFDEKLAEKLYEIEYSPIAVIAFGFIKKGLGHHLDGFGFLVPRSEGRKILGVLWDSSVFPNRAPEGKALIRAMVGGARQPHLALAGEEEIARMTYKDIKRIMKIRHRPIMTAVFKHPKGIPHYTVGHVEKVNEIFKLASNHGGLFLNSNAYRGVGVNDCVYNSLKTAEMVTSE

SEQ ID NO: 80 - protein, 484 aa, Arthrospira
MTNLVDSLIVGAGISGLSLAYSLNREKSVREPLKVLVTESQNRVGGNITTGRADDFLWEEGPNSFAPTPELLGLAVDLGLKEELIFADRKLPRYVYWNLMLHPVPMNPPALLSSELISARGKLRAALGAIGFVPPPVGAHLSQQGGEETITQFFDRHLGSEVLERLVQPFVSGVYAGDPQQLAVRSAFSRIVAAEEAGGGLLPGFVRSRLNKKAPVSTPDPNIPKTRPGELGSFRYGLQTLPETLASKLGDRVKLNWTIDRFYPTDHQTYIAEFSTPDGPQQVEARTLALMTPAHVSARLLQPLHSPIATALSQIPYPPVACVVLAYPKSALKQQLKGFGNLIPRHQGIRTLGTIWTSSLFPGRAPESWQVLSNYIGGATDPEIGEMDDDQIVAAVHQDLRQILLAEDVPPKVLAVHLWRRAIPQYTLGHQNRLNCIDAGLRSLPGLYLCSNYIDGVSVGDCVRRGQQWASKIQSHLHDCQTAN

SEQ ID NO: 81 - protein, 462 aa, Leptospirillum
MAGFDCDTLVVGGGISGLAAALTLKNRGVDVRLLESRGYLGGAVRTVREEGYLLEFGPNSLMVRPDDAIDAVLGDPELRARIVAASGLSKNRYVVKSGNLYPVPLSPWAFIRTPLLSWRGRRDILSEWKVPPRTGGPEETLSHFVRRRLGEEALDYFVDPFVKGVYASHPDLLSVEAAFPLLVRLEREHGGLLRGALKTFLKRRKRPSGSAPRGIFSFTGGMGDLVEAMGKRLGEDVGTNVDVIKYTRLEEGFRVALMYDETEYYMTSRRLILATSAPQAAELLEGDPEGPSGELKAIPYAPVTIAYAGFLREQITHPLDGFGLLCPTAENRKVLGVIFSSSLFPGRAPDGKVLLTVFVGGMTGQKLAQTFDEDLERIVLRELTELLGVKGAPAFFRIHRWEKAIPQFILGHGETVRTIRKKLPSGLRLAGNYLDGISIARAFGSGVRAAEELLSEDGGTPG

SEQ ID NO: 82 - protein, 458 aa, Verrucomicrobiae
MQDAIILGGGISGLTAGYLAQKQGQDISVIEKGKIPGGPISSFREEGYLVERGPNSLLLPDPWVETFIEELGLRDQLQETNPIASKRYIVKNGRPEAVPSSPLQAVFTPLFSLRGKFGFLLEPFRKKISDRAGSRETVASFVKRRMGLDFLDYAIDPFVSGVYAGDPNRLILEHAFPLMRGFERDSGSIIRGAIKHKKKQKREGTAYKKRSISFKDGLGILPQTIARKLGNRLWLGSEVVAVNRVEDHWQVTWKREGENFEGFAKNLLVCLPSHAIKRIAWSERIAAPLRSSPNLEYPAVHSLALGFRREQIAHALDGFGVLVPSKEPPTILGALFSSSLYEGRAPDGHCLLTVMLGGIRHPELAALPQDRLLELALRDLRALLGLKGDPSFYRCTSWPRAIPQYTRDFGPWRDTLKSLAEEFPGLHFGGNSVDGIAMGASILSGKRLAECLDKDIDV

SEQ ID NO: 83 - protein, 446 aa, Verrucomicrobia
MNTKKVCILGAGLSGISLGLSHENKGNQVTIFEKDLRVGGVLQSIKSEGFLMDYGGNTLSIRTKKTVDFLKQYEILEHAMDANQESSKRFIIRKNRIISLPQGPLSFLFSSFLSPVGKLRLCLEPFIGRKKDNGSDETMAEFVERRLGREVLDYGVNPFIGGVYAARPESLILKYAFPSLHDTELTFGSIFWGMIRGGTQPSEKISKSRLISFREGMQELPNRLATRMHNPPVLGCEIKKIEFKDDVQWCVQGETRDGKIQKEVFDQVICTLPSHALDKIEWVGINSSHLLETLTRAYHPPLALAFQGYQQRQIKHPLDGFGFLVPEKERRKILGTLFSSTLFQNRAPENSVLLTTFIGGERNPELCDLPQNEILGHAFRENQDLLGIEGNPIFEHLKLWPKSIPIPDHTLEDRKKAASTLTLENKGLQILGAHINGAPLPNCMVL

SEQ ID NO: 84 - protein, 485 aa, Synechococcus
MNPATPEPLNAEVVVIGAGISGLTLAWRLQQGLSARGGSPQAVLLAEASSRVGGCISTQSKDGYRWEEGPNSFTPTPALLNLIAEVGLTDQLVLADAKLPRYIYWEGALLPVPLSPAAALGSRLLSVGGKLRALQGLLGFVPPPPGHEETVRQFFRRQLGSEVAERLVEPFTSGVYAGDPDQLSAVAAFPRVAGLEERYGSLFAGALQALRQRPQPSPAAIQPPPKRGQLGNLRQGLQQLPEALAQKLGDSLRLGWRALQLKRAGELYWVGFETPEGSRWVAARQVVLALPAYEAAALLQELNPPASQLLAEILYPPVAVVALAYPQEALPQPLRGFGHLIPRSQGLRTLGTIWASCLFPERAPQGYHSFLSFLGGATDAALARRRGIPPIPALSPEERAQIAHAELSQVLLTRRAEPVYLGERLWPRAIPQYTLGHRQRIAQVQAHLASQTPGIWVCANYLDGVALGDCVRRAEALAQQLLSQV

SEQ ID NO: 85 - protein, 443 aa, Hymenobacter
MTIAILGGGISGLVVAWQLQKAGVAYDLFEAETTPGGCLRSVSHPDGYLVETGPNSLQLSDELLELITELGLVDEIQDAAAVSKNRYVLRNGRYQQLPSTPPALLTNGFFSWKAKFNILRELRRPAAPLNPTETVDAFFRRRFGPEIVDYAVNPFISGIYAGDPAQLLIHKTFSKVAALEQQYGSVLRGLAKTGGGAGRRRIISLQGGIQKLTDTLAAKLTHHHVRQRVLALHRTTKGGYQVQTSAGSNGGFSYDAVVLALPTFAAAPLLAPLFPEAAAALAAVHYPPMAAVYTAYRREDVGHPLDGFGALHPKVEQPYAAGSIWTSSIFPNRVPDGQVLFTTFVGGAQYEANAQQSETAQKAAVHEELSRFYDIKAAQPLWQYRYLWDKAIPQYDQRIMAAHTTTDALQAQGIWSAANWRGGVGVPDCIRHARHVADQLTGK

SEQ ID NO: 86 - protein, 448 aa, Pontibacter
MRVAIIGAGISGLSLAYYLQRQGVAYDLFEAGSEVGGNMRTLRKNGYTFELGPNTLQMNEELLQLITELKLETELLPLTPRNNKRYVLHDGKLYPVPASPKSFLANDLFSNEEKHRILQERKQPPAEVENETVSDFFERRFGVKQMDYLAAPMISGLYGGDPRQLLVNKAHPELKELETQYGSVLEGMVQKKKRGVFQRAFSFRNGMSTLPHAIADKLISLHLDHKVEFITRIKGKFIISCASNGDHDNEEYDKLVLALPAHQAAELIEFTYPGMSAALQNINYPPMAVVHTVYNRAEVGHPLQGFGALHPWEEQSFTSGSIWTSSLFEGRCRSHEVLITSYVGGTRFAEHAQLEERSLLEQVHQELCQTYQIKALAPVYQHLHLWQHALPQFDLYIEDAHHMAEVLEQDGLFISANWYAGVSVPDCVREAKAIAAKINTRAASRSIA

SEQ ID NO: 87 - protein, 463 aa, Leptospirillum
MATEDVETLVIGGGIAGLACASHLKLAGRTVRLVERNDYLGGVIRTLSDSGYRIETGPNSLLVRTEEPLLKYLSRPEIAARIQLAGRMGKKRFILKDGHPVALPMSLSEGIFTQILSLPAKVRLLKEPFIPPAGGVDGVDPEKETVADFVRRRLGNEFLESLIDPFVKGVYASDPHLLSMADTFPRLVQMEKSYGSLIKGGLALARQKKAPAPAFAREILSFSEGMGTLPESLANILDDDAGTNAEVIGCAPSESGFRTALLFEEETYYIRSKHLVLALPAAQTAELIEPMAPGIPSLLGQIPYAPIAVVYLGYPRDRISHPLDGFGLLVPSRERRKILGALFSSSLFPGRSPDGHVLLTVFVGGMTQPKLAQAFDEDLLPMVTKEIGSMLGVLGAPSYVRIQRWAGAIPQSVPGHGERIRSIESALPSGLHLAGSYLSGVSVSQTFSSGIRAAEKILAQSPG

SEQ ID NO: 88 - protein, 451 aa, Prevotella
MERQRKIIVIGAGLTGLTCAAHLRHKGQDVEVLEATERIGGLMQTEDFDGFIMEQGPSTGTIKYPEVAELFDMLGDKCTLEVAQSSAKCRLIWKDGHFCALPSGLWSAVTTPLFTLKDKFRILGEPWRRKGTDPNESVGALAERRLGRSFVDYAVDPFLSGVYAGDPYKLPTRLALPKLYNLEQHYGSFIKGAMALAKAPKSDRDKRATKEVFSTRGGFRSLVSALAKTIGDDRITTGCAHLHVEPLGDKWKLSWGENTIIADQVVTTCPAYSLPDLLTFLPKEQLDDLSNLYYAPVIEIGVGMKHTGNVHWNAFGGLVPSKEQQKVLGILMPSACFVGRSPEEGATYAFFIGGARHPEYLDKTDEELRELVNTSLHTMLGYPKGTQADAIRIYRHSHAIPQYMTETDSRLRAIDTVEHTYPSLHIIGNLKDGIGMGDRIKQAVDLAERIG

SEQ ID NO: 89 - protein, 436 aa, Flexithrix
MVGIIGAGISGLSLAYHLQKLGKAYCLFEAGDKPGGNICSVKKEGFLLEKGPNSLLADSEIIDLVKELGLEDQMIIPETVSKKRYIFKNGKYQQLPSSPPGLIFNNFFSWHAKFSIYKELNNKSTSPQNETVADFFERRFCKEIVDQAVNPFISGIYAGDPEKLIMEKTFPAFLENEQKFGSVIRGFIKNKKNTQRKLTFSFKEGLGILADKLAENLSVNYNSPIKEIRQEAGGFLLITENGETKVTALVFSIPAYAAGKLIKDISPESAQAWEGVNYPPICVVHTAFRRKDLGFDFNGFGGLNPKKEDLFTAGSIWNSSLFENRSPKDQFLITSFVGGAQSLDNFQLTDEEIKAKVTDELQQNFKIKGSPTHQEITRWEKSIPQYDIDIFPAHQAIENLQREGIYVCSNWEGGVSVPDCIKKGKQLAERIKENKF

SEQ ID NO: 90 - protein, 469 aa, Geobacter
MKKVIVVGGGISGLATAFELRNKGAEAGIELDVTLLEKEERVGGKIWSIKEEGYLCEWGPNGFLDSKPQTLDLCRDLGASERLLRSNDNARKRFIYTGGVLNRLPENGPTFLKSSLISWPGKLRLAMEPFISKRTDGTDETLASFGRRRLGEEALQKLISPMVSGIFAGDPETMSLRSCFPRIAELEDEYGSLIKAMIKLAKKKKQEAAQGKAVSSAAGPGGVLTSFRWGIQELTDILAEQLGSATVVTGQPVTGLTRGSSVPWRLKTPTVDIDADVVILASPAHATAGIVSGVDAAMAQVLGEIPYASMTVVCFGFERERIAYDLNGFGYLIPKDEGMNTLGTLWDSSIFENRAPEGKVLLRSMLGGACFPEYVKLSDAEVMQRVKADLKATMGITADPSFIRIFRHPQAIPQYTVGHGKRLAALQERSSALPGLFLTGNSYRGIGLNDCATAANRTTDEVVAYLKGR

SEQ ID NO: 91 - protein, 498 aa, Synechococcus
MQAEVVVVGAGISGLTLALRLQQGLSPKDESTQPLLLAEASSRVGGCISTQSKDSYRWEEGPNSFTPVPALLNLIAEVGLAEHLVLADAKLPRYIYWEKELLPVPLSPSAAIGSRLLSVGGKLRALRGLLGFVAPPPGGEETVRQFFRRQLGSEVVERLVEPFTSGVYAGDPDQLSALAAFPRIAGLEERYGSLFAGAVQALRSRYRYATLPRTRHQDSANSPIQPPPKRGQLGNLRQGLQQLPEAIAQKLGSALRLGWRAVHLKRDETGYRVGFVIHDSGAEHTAPEEIHWVAAQQVVLTLPAYAAATLLQDLNPQASRLLREIPYPPVAVVALAYPEEALPQPLRGFGHLIPRSQGLRTLGTIWASSLFPERAPQGYHCLISFIGGATDAAFARQKGIPPITALSPDERAQIVHAELSQILLTRPVEPIRLGERLWPQAIPQYTLGHRQRIAQLQASLADQTPGVWVCANYLDGVALGDCVRRAEALAQQILSVRR

SEQ ID NO: 92 - protein, 475 aa, Crinalium
MVDTLIIGAGISGLSLAYALHQDGRKVLLCERQERVGGNITTGKAGGFLWEEGPTSFTPTPALLKLAVDVGLREELVLADHRLPRFVYWKGQLLPVPMSPPSAVTSKLLSLSGKFRALVGALGFIPPAIGNHLSQQGGEETVAQFFKRHLGTEVAERLVAPFVSGVYAGDVHQLSARSAFRRIAQLENVGGGLVSGAILSRKQRQQQKPPTDPSLPTVRRGELGSFKEGLQSLPKAIASHLGENIKLNWTLTELRQTANQTYIAEFSTPEGSQQVEARTVVLTTPAYVTAELLHNLAPNASIALKEIPYPSVACVVLAYPDDALKFPLKGFGNLIPRGQGIRTLGTIWSSSLFPGRAPQGWQMLTNFIGGATDPEVGNLDNEQLVQAVHKDLQRVLLKKDVPPKAIAVHLWKRAIPQYTLGHHLRLAQINQDLAQLPGLYLCSNYTDGVSLGDCVQRAYDQLPIINKQLSIINDN

SEQ ID NO: 93 - protein, 486 aa, Planctomyces
MNQSAPAKRIAVVGGGITGLSAAFHLQELAQEKNQPVEVTLFESQPEAGGWIGTISQDGYRIDTGADMFITNKPAAIELCQRLGLEDQLISTNQQYRGALILKDGTPVPVPLGFELMTPSRILPMLKTPLLSPIGKLRMGLEYFLPRRTSESGLDADDESLAQFVTRRFGREALTRLIQPLVAGIYTSDPEKLSLRATLPRFLDMERDHRSLIKAIRKQKKQTKSADATGARYGLFAAFKEGMQTLIRTLADRVSSTGTILYEHRVTHVAAADSGYDLTIESTVETQTQHFDAVLLTTAAPQAGQMLEAYAPVLSGLLKQIEYASTAIQVSVYRQENIKHPLHAFGLVIPAAEQRKIFAVAFASRKFPGRAPEGCVQLRTFVGGAMQPELLEHSDDELNAIVNQELADILGVSGEPIFSKLLRHNQSMPQYHLGHLQLVERIEQSAATLAGLELAGNAYRGVGIPDCIHSAEQAAERLLVDLTARV

SEQ ID NO: 94 - protein, 471 aa, Geobacter
MKKAIVVGGGISGLASAYLLREKAKNSGMELEITIVEKEDRTGGKIRSIKEDGYLCEWGPNGFLDSKPQTLDLCRELKVDSQLLRSNDNARKRFIYSGGVLNRLPENGPSFLKSRLISWPGKLRLALEPTPFIAKAPEGVDETLAAFGRRRLGDEALRKLIAPMVSGIFAGDPETMSLVSCFPRIAELEREYGGLVKAMVKLAKKKKQEIAEGKQVASAAGPGGVLTSFRDGIQTLTDILNERLGKDMLVIGAEVTGVSRGNSTPYRVQTGGRELDADIVVLATPAYATAQALEGIDGGMSATLNQIPYATMTVVCFGYEQEKVAHDLNGFGYLIPKAEGMNILGTLWDSSIFENRAPEGKVLLRSMMGGACFPEYIRLSDAEVVQKVRDNLKTIMGIKEAPEFVRIFRHEKAIPQYTVGHGRRLAALEEQAKSHPGLFLSGNSYRGIGLNDCVAAANRTADEVVAFLQSR

SEQ ID NO: 95 - protein, 446 aa, Acidithiobacillus
MEDVIIIGAGISGLATAYFLRKQGWSPLLLEAAAKPGGNLQSRQEEGYLRDMGPNSLMLKGHIVPEWLRELRLEEDIVEANPLAKRRYILNRHRQPVALGPGVLFGGGLLSWRGRLRLLGEPFRSPRRMQDSEESVADFVRRRLGEEALTWLVDPFISGVFAGNPARLSVQATLPRLIALEQDGGSLLRGALRARNKKSPDTPKTRLISFREGLQTLPLRVASALGDALRCNTPVEQLGNSDGSWQVSSGSQTWQSKRLILALPAGAAARLLAPTDAALAHELDAIPYPAVGSLSIGFQRMQVQHPLDGFGILIPRVMGLETLGILFSSTLFPGRAPADQVLLTAFIGGSQNDISGRDDDDLLATALREICPLLGISGKPVFSRCQTWPKAIPQYEIGHLDRIKRIDALSARHPGLYFRANWREGVALGDCMEEAYRFSQDVGWQR

SEQ ID NO: 96 - protein, 454 aa, Prevotella
MEERKIVVVGAGLTGLTCAAYLRRKGQDVVVLEAADRIGGLMQTEEVDGFVMEQGPSTGTIKYPEVAELFDMLGDDCTLEVAQSSAKCRLIWKDGRFHALPSGLWSAITTPLFTLKDKFRILGEPWRKKGIDPNESVGSLAERRLGRSFVDYAVDPFLSGVYAGDPYQLPTRLALPKLYDLEQRYGSFIKGAMALAKQPKTDREKRATKAVFSTRGGFRSLVSALGRVIGDERIRTNCKELSIEPLGDKWKLSWGENTIIAEQVITTCPAYALPKLLNFLPKEQLDDLSNLYYAPVIEIGVGMKNTGDVHWNAFGGLVPSKEKQNVLGVLMPSACFQGRSPKEGANYACFIGGACHPEYINKTDEELIGLVNTSLHTMLGYPKGTCADVIRIYRHSHAIPQYMPETDARLRTIDAVELAYPGLHIIGNLKDGIGMGDRIKQAVDMAEKISLSVS

SEQ ID NO: 97 - protein, 458 aa, Thermovibrio
MRVCVIGGGVSGLSTAFYLKRGGAQVKLLERENYPGGKARTYYEKGYIVESGPNGFLDGKPDTLELVKLLGAEKLLYRSSDKARKRFIYKNGRLVRLPENPIAFLSSYLLSWKGKVRVLGELLVPPSEKEDETLAEFVRRRLGKEALDYLLDPMVAGIFAGDPERMSLKAAFPTIYRLEREYGGLIRGLIAKAKEAKKKGAKSSGPAGPGGVLTSFVKGMSQFTQLLAQELGESFTPEAQVKTLEKKKDKWLVTYTLRGKEKSEEFDAVVLSLPAYAAAQVLKETSRELSELLASIEYSPISVVALGFEKRGLGHNLDGFGFLVPKVEGRKILGALWDSSVFPNRAPEGKALIRVMIGGARQPELALKSEEELTEIALKELKRIMKIRHYPEMVKVFRHEKGIPHYTIGHAEKVERIFKLGRELGNLFFCNNAYKGVGINDCTKSARETAEEVLNSLC

SEQ ID NO: 98 - protein, 536 aa, Brassica
MDLSLLRPQPFLSPFSNPFPRSRPYKPLNLRCSVSGGSVVGSSTIEGGGGGKTVTADCVIVGGGISGLCIAQALVTKHPDAAKNVMVTEAKDRVGGNIITREEQGFLWEEGPNSFQPSDPMLTMVVDSGLKDDLVLGDPTAPRFVLWNGKLRPVPSKLTDLPFFDLMSIGGKIRAGFGAIGIRPSPPGREESVEEFVRRNLGDEVFERLIEPFCSGVYAGDPAKLSMKAAFGKVWKLEENGGSIIGGAFKAIQAKNKAPKTTRDPRLPKPKGQTVGSFRKGLTMLPEAISARLGDKVKVSWKLSSITKLASGEYSLTYETPEGIVTVQSKSVVMTVPSHVASSLLRPLSDSAAEALSKLYYPPVAAVSISYAKEAIRSECLIDGELKGFGQLHPRTQKVETLGTIYSSSLFPNRAPPGRVLLLNYIGGATNTGILSKSEGELVEAVDRDLRKMLIKPSSTDPLVLGVKVWPQAIPQFLIGHIDLVDAAKASLSSSGHEGLFLGGNYVAGVALGRCVEGAYETATQVNDFMSRYAYK

SEQ ID NO: 99 - protein, 521 aa, Brassica
MASNAVADHDKPVSGKRVAVVGAGVSGLAAAYKLKSKGVNVTVFEADGRVGGKLRSVMHNGLIWDEGANTMTEAEPEVGSLLDDLGLREKQQFVSTFHALSIMFQPLSQKKRYIVRNGLPVMIPTNPIALVTSSVLSTQSKFQILLEPFLWKKNDSSSKVSDASVVESVSGFFQRHFGQEVVDYLIDPFMGGTSAADPESLSMKHSFPDLWNIEKSFGSIIVGAIRSKFAAKGSKNGETKSSTGTKKGSRGSFSFKGGMQILPDMLCKDLSREDLNLDSKVLSLSYNTGPREENWSLSCVSHNETQRQNLHYDAVVMTAPLCNVKEMKVMKGGEPFKLNFLPEIKYMPLSVIITTFTKEKVKRPLEGFGVLIPSIEQKHGFKTLGTLFSSMMFPDRCPSDLHLYTTFIGGSRNQELAKASTDELKQVVTSDLQRLLGIEGEPVFVNHVYWNKAFPLYDRSYDSVMEAIDKMEKDLPGFFYAGNHRGGLSVGKSIASGCKAADLVISYLESCSNDNKPEDSL

SEQ ID NO: 100 - protein, 539 aa, Gossypium
MTALIDLSLLRSSPSVSPFSIPHHQHPPRFRKPFKLRCSLAEGPTISSSKIDGGESSIADCVIVGGGISGLCIAQALATKHRDVASNVIVTEARDRVGGNITTVERDGYLWEEGPNSFQPSDPILTMAVDSGLKDDLVLGDPNAPRFVLWEGKLRPVPSKPTDLPFFDLMSIAGKLRAGFGAIGIRPPPPGYEESVEEFVRRNLGAEVFERFIEPFCSGVYAGDPSKLSMKAAFGRVWKLEEIGGSIIGGTFKTIQERNKTPKPPRDPRLPKPKGQTVGSFRKGLTMLPEAIANSLGSNVKLSWKLSSITKLGNGGYNLQFETPEGMVSLQSRSVVMTIPSHVASNLLHPLSAAAADALSQFYYPPVASVTVSYPKEAIRKECLIDGELKGFGQLHPRSQGIETLGTIYSSSLFPNRAPSGRVLLLNYIGGATNTGILSKTEGELVEAVDRDLRKMLINPNAKDPLVLGVRVWPKAIPQFLVGHLDLLDSAKMALRDSGFHGLFLGGNYVSGVALGRCVEGAYEVAAEVKEFLSQYAYK

SEQ ID NO: 101 - protein, 503 aa, Gossypium
MASTENKDDHSSAKRVAVIGAGVSGLAAAYKLKSQGLHVTVFESEGRAGGKLRSVSREGLIWDEGANTMTESEIEVRSLFDDLGIQDKEQVPIAQNKRYIVRNGVPVLIPSNPLALFTSSILSAKSKFQIILEPFLWRKSEASKVSDAYNQESVGGFFQRHFGQEVVDYLVDPFVAGTSAGDPESLSMCHSFPELWDLEQRFGSIIVGAVKSKFSAKRTNREETKNSVKRKALRGSFSFQGGMQTLADMLCKDLSKDELKLKSKVLSLSYSHEGKSTSENWSLSYASDRDKRSQGSSFDAVIMTAPVCNVKEMKITKGGNVFPLNFIPEVSYMPLSVIITAFKKENVKKPLEGFGVLIPSKEQQNGLKTLGTLFSSVMFPDRAPNNLYLYTTFVGGNRNKELAKASTDELKHIVTSDLQQLLGVEGEPTFFNHFYWSKAFPLYGRNYASVLEAIEKIERDLPGFFYAGNHKGGLSVGKSIASGCKAADNVITYLESSHDKLLK

SEQ ID NO: 102 - protein, 535 aa, Conyza
MTSLTNFTPLKLTNPNYLTTTTTYNHRKLSNFRFRCSIARDSPTAPSISGDSSSRPLLDCVVVGAGISGLCIAQALSTKHGGDVVVTEARERVGGNISTVERDGYLWEEGPNSFQPSDPMLTMVVDSGLKDDLVLGDPTAPRFVLWDGDLKPVPSSPSDLPTFDLMSLGGKLRAGFGALGIRPPPPDREESVEEFVRRNLGDEVFERLIEPFCSGVYAGDPSKLSMKAAFGKVWKLEQNGGSIVGGAFKAIQAKNKSTKPPRDPRLPTPKGQTVGSFRKGQAMLPNAISKGLGSRVKLSWELVGITKSENRGYSLTYRTPDGLESLQTKTVVMTVPSYVASDLLRPLSVEAADALSKFYYPPVAAVSVSYPKEAIRADRLIDGQLKGFGQLHPRSQGVETLGTIYSSSLFPNRAPPGRVLLLNYIGGATNPGILSKTESQIVEAVDRDLRKMLINPKAGEPLTLGVKVWPRAIPQFLIGHYDILEAAKCALSLAGYRGMFLGGNYVSGVALGRCVENAYEVAADVSNFLSRGVYK

SEQ ID NO: 103 - protein, 498 aa, Conyza
MASPTTTTDDNKEKAPAKRVAVVGAGVSGLAAAYKLKLHGINVTVFEAGEIAGGKLRSISQNGLIWDEGANTMTESEPDVSRLLDDLGLRDKQQSPLSQHKRYIVRNGKPVLVPSNPIALIQSSLLSTQSKLQILLEPFSWKKKNSSDTQESVGAFFQRHFGKEVVEYLINPVVAGTSGGDPESLSMRYSFPELWDLERRFGSLISGAFQSMISSRGRKKSPSGSSKRRRGSFSFLGGMQTLTNALSKEVGQHELNLQSKVLEMSYSCDDNTTGNWSIYCAPDQNKQLNQQPFDAVIMTAPLGNVKEMKITKTGSPFLLNFIPELSYMPVSVIISTFKKENVKRPLEGFGMLVPAKEQENGLKTLGTLFSSMMFPDRAPEDLYLYTTFVGGSRNKELANASRDELKQIVTSDLRQLLGAEGEPQFLTHYYWSKAYPLYGRDYGLVMEAIEKMERELPGYFYAGNHKGGLAVGKAISSGCKAAESVISYLDSYSDEKRC

SEQ ID NO: 104 - protein, 565 aa, Kochia
MSAMASPSIIPQSFLQRSPTSLQSRSNYSKNHIIISISTPCSHGKNQRRFLRKTTHFRSIHCSTISTSTPTSSSNPGTLGEGGLLDCVIVGGGISGLCIAQALSTKYSSLSTNFIVTEAKDRVGGNITTKEDDGYIWEEGPNSFQPSDAVLTMAVDCGLKDELVFGDPKAPRFVLWNGKLRRVPSKLTDLPFFDLMSFPGKIRAGLGALGFRPSPPGREESVEDFVRRNLGDEVFERLIEPFCSGVYAGDPAKLSMKAAFGRVWVLEQMGGNIIGGALKTIQEKKNKPKPPRDPRLPKPKGQTVGSFRKGLIMLPNAISARLGSKVKLSWTLASISKTHNGEYNLIYDTPDGPVSVRTKSIVMTIPSYVASSLLRPFSDAAADSLSKFHYPPVAAVSLSYPEEAIRPECLIDGKLQGFGQLHPRSQGVETLGSIYSSSLFPGRAPPGRTMILSFIGGATNPGIVDKTQDELAKTVDKDLRRILINPSAKDPRVLGVKVWPQAIPQFLIGHFDLLDAAKAALTDAGCKGLFLGGNYVSGVALGRCIEGAYESAAEVVDFLSQYSDK

SEQ ID NO: 105 - protein, 531 aa, Lolium
MVGATMATATVTAALPLRLRVPARSRRGQTRCAVASDATEAPAVPSARLSADCVIVGGGISGLCTAQALATKYGVTDLLVTEARARAGGNITTVERPDEGYLWEEGPNSFQPSDPVLTMAVDSGLKDDLVFGDPNAPRFVLWQGKLRPVPSKPGDLPFFDLMSIPGKLRAGLGALGIRPPPPGREESVEEFVRRNLGAEVFERLIEPFCSGVYAGDPSKLSMRAAFGKVWRLEENGGSIIGGTIKAIQDRGKNPKPPRDPRLPTPKGQTVASFRKGLAMLPNAIASRLGSKVKLSWKLTGITKSDNQGYVLAYETPEGVVSVQAKSVIMTIPSYIASEILRPLSSDAADGLSKFYYPPVAAVTVSYPTEAIRKECLIDGELQGFGQLHPRSQGVETLGTIYSSSLFPNRAPAGRVLLLNYIGGATNTGIVSKTESDLVEAVDRDLRKMLINPTAPDPLALGVRVWPQAIPQFLIGHLDRLDAAKSALARGGCSGLFLGGNYVAGVALGRCIEGAYESASEVSDFLTKYAYK

SEQ ID NO: 106 - protein, 509 aa, Lolium
MAASDDPRAAPARSVAVVGAGVSGLVAAYRLRKSGVRVTVFEADDRAGGKIRTNSDGGFLWDEGANTMTESALEASRLIDDLGLEGRLQYPNSQHKRYTVKDGAPALIPSDPIALMKSSLLSTKSKFKLFLEPFLYEKSSTNNSKKVSDEHIRESVGSFFERHFGKEVVDYLIDPFVAGTSAGDPESLSIRHAFPALWNLEKKYGSIIAGAILSKLTAKGDSTKKGSAVSGKGRNKRVSFSFHGGMQTLVDALHKEIGDGNVKLATQVLSLACSCDGLSASNGWSIFVDSKDASNRELAKNQPFDAVIMTAPLSNVQRMKFTKGGAPFVLDFLPKVDYLPLSLMVTAFKKEDVKRPLEGFGVLVPYKEQQKHGLKTLGTLFSSMMFPDRAPNDQHLFTTFVGGSHNRDLAGAPTAILKQLVTSDLRKLLGVEGQPTFVRHIHWKNAFPLYGHDYDSALEAIGKMESDLPGFFYAGNNKDGLAVGNVIASGSKTADLVISYLELGIKRDN

SEQ ID NO: 107 - protein, 539 aa, Gossypium hirsutum
MTALIDLSLLRSSPSVSPFSIPHHQLPPRSRKPFKLRCSLAEGPTISSSKIDGGESSIADCVVVGGGISGLCIAQALATKHRDVASNVIVTEARDRVGGNITTVERDGYLWEEGPNSFQPSDPILTMAVDSGLKDDLVLGDPNAPRFVLWEGKLRPVPSKPTDLPFFDLMSIAGKLRAGFGAIGIRPPPPGYEESVEEFVRRNLGAEVFERFIEPFCSGVYAGDPSKLSMKAAFGRVWKLEEIGGSIIGGTFKTIQERNKTPKPPRDPRLPKPKGQTVGSFRKGLTMLPEAIANSLGSNVKLSWKLSSITKLGNGGYNLTFETPEGMVSLQSRSVVMTIPSHVASNLLHPLSAAAADALSQFYYPPVASVTVSYPKEAIRKECLIDGELKGFGQLHPRSQGIETLGTIYSSSLFPNRAPSGRVLLLNYIGGATNTGILSKTEGELVEAVDRDLRKMLINPNAKDPLVLGVRVWPKAIPQFLVGHLDLLDTAKMALRDSGFHGLFLGGNYVSGVALGRCVEGAYEVAAEVKEFLSQYAYK

SEQ ID NO: 108 - protein, 560 aa, Beta vulgaris
MKSMALSNCIPQTQCMPLHSSGHYRGNCIMLSIPCSLIGRRGYYSHKKRRMSMSCSTSSGSKSAVKEAGSGSGSGAGGLLDCVIVGGGISGLCIAQALCTKQSSLSPNFIVTEAKDRVGGNIVTVEADGYIWEEGPNSFQPSDAVLTMAVDSGLKDELVLGDPNAPRFVLWNDKLRPVPSSLTDLPFFDLMTIPGKIRAALGALGFRPSPPPHEESVEHFVRRNLGDEVFERLIEPFCSGVYAGDPAKLSMKAAFGKVWKLEQKGGSIIGGTLKAIQERGSNPKPPRDQRLPKPKGQTVGSFRKGLVMLPTAISARLGSRVKLSWTLSSIVKSLNGEYSLTYDTPDGLVSVRTKSVVMTVPSYVASRLLRPLSDSAADSLSKFYYPPVAAVSLSYPKEAIRSECLINGELQGFGQLHPRSQGVETLGTIYSSSLFPGRAPPGRILILSYIGGAKNPGILNKSKDELAETVDKDLRRMLINPDAKLPRVLGVRVWPQAIPQFSIGHFDLLDAAKAALTDTGVKGLFLGGNYVSGVALGRCIEGAYESAAEVVDFLSQYSDK

SEQ ID NO: 109 - protein, 530 aa, Hordeum vulgare
MAGAGATMATATAPPLRGRVTRRPHGVRPRCAAAGSATETPAAPGVRLSADCVIVGAGISGLCTAQALATRHGVGDLLVTEARDRPGGNITTVERPDEGYLWEEGPNSFQPSDPVLTMAVDSGLKDDLVFGDPNAPRFVLWEGKLRPVPSKPGDLPFFSLMSVPGKLRAGLGALGIRPPPPGREESVEEFVRRNLGAEVFERLIEPFCSGVYAGDPSKLSMKAAFGKVWRLEEIGGSIIGGTIKAIQDKGKNPKPPRDPRLPAPKGQTVASFRKGLAMLPNAIASRLGSKVKLSWKLTSITKADNQGYVLGYETPEGLVSVQAKSVIMTIPSYVASDILRPLSIDAADALSKFYYPPVAAVTVSYPKEAIRKECLIDGELQGFGQLHPRSQGVETLGTIYSSSLFPNRAPAGRVLLLNYIGGSTNTGIVSKTESDLVEAVDRDLRKMLINPRAADPLALGVRVWPQAIPQFLIGHLDRLAAAKSALGRGGYDGLFLGGNYVAGVALGRCIEGAYESASQVSDFLTKYAYK

SEQ ID NO: 110 - protein, 554 aa, Hordeum vulgare
MLTSATAPPSSSSCSSHAPARFASPSRPRRSASASARGRGRRVRPVLAMAASDDPRARSVAVVGAGVSGLVAAYMLRKSGVRVTVFEAEDRAGGKIRTNSDGGFLWDEGANTMTESALEASRLIDDLGLQDRLQYPNSQHKRYTVKDGAPALIPSDPIALMKSTVLSTKSKFKLFLEPFLYEKSSTRNSKKVSDEHLRESVGSFFERHFGKEVVDYLIDPFVAGTSAGDPESLSIRHAFPGLWNLEKKYGSLIVGAILSKLTAKGGSAKKGGASSGKGRNKRASFSFHGGMQTLVDALHKEVGDTNVKLGTQVLSLACNCDGLSASDGWSIFVDSKDASSKELARNQSFDAVIMTAPLSNVQRMKFTKGGRPFVLDFLPKVDYLPLSLMVTAFKKEDVKRPLEGFGVLIPFKEQQKHGLKTLGTLFSSMMFPDRAPNDQHLFTTFIGGSHNRDLAGAPTAILKQFVTSDLTKLLGVEGQPTFVKHIHWRNAFPLYGHDYDLALEAIGKMEGDLPGFFYAGNNKDGLAVGNVIASGSNTADLVISYLESGIKHVN

SEQ ID NO: 111 - protein, 531 aa, Triticum aestivum
MAGATMATATVAAASPLRGRVTGRPHRVRPRCATASSATETPAAPGVRLSAECVIVGAGISGLCTAQALATRYGVSDLLVTEARDRPGGNITTVERPDEGYLWEEGPNSFQPSDPVLTMAVDSGLKDDLVFGDPNAPRFVLWEGKLRPVPSKPGDLPFFSLMSIPGKLRAGLGALGIRPPPPGREESVEEFVRRNLGAEVFERLIEPFCSGVYAGDPSKLSMKAAFGKVWRLEEIGGSIIGGTIKAIQDKGKNPKPPRDPRLPAPKGQTVASFRKGLAMLPNAIASRLGSKVKLSWKLTSITKADNQGYVLGYETPEGLVSVQAKSVIMTIPSYVASDILRPLSIDAADALSKFYYPPVAAVTVSYPKEAIRKECLIDGELQGFGQLHPRSQGVETLGTIYSSSLFPNRAPAGRVLLLNYIGGSTNTGIVSKTESDLVGAVDRDLRKMLINPRAADPLALGVRVWPQAIPQFLIGHLDRLAAAKSALGQGGYDGLFLGGNYVAGVALGRCIEGAYESASQVSDFLTKYAYK

SEQ ID NO: 112 - protein, 501 aa, Solanum lycopersicum; identical to SEQ ID NO: 21

SEQ ID NO: 113 - protein, 546 aa, Triticum aestivum
MGIHPAALTFPRATEMAGATMATATVAAASPLRGRVTGRPHRVRPRCATASSATETPAAPGVRLSAECVIVGAGISGLCTAQALATRYGVSDLLVTEARDRPGGNITTVERPDEGYLWEEGPNSFQPSDPVLTMAVDSGLKDDLVFGDPNAPRFVLWEGKLRPVPSKPGDLPFFSLMSIPGKLRAGLGALGIRPPPPGREESVEEFVRRNLGAEVFERLIEPFCSGVYAGDPSKLSMKAAFGKVWRLEEIGGSIIGGTIKAIQDKGKNPKPPRDPRLPAPKGQTVASFRKGLAMLPNAIASRLGSKVKLSWKLTSITKADNQGYVLGYETPEGLVSVQAKSVIMTIPSYVASDILRPLSIDAADALSKFYYPPVAAVTVSYPKEAIRKECLIDGELQGFGQLHPRSQGVETLGTIYSSSLFPNRAPAGRVLLLNYIGGSTNTGIVSKTESDLVGAVDRDLRKMLINPRAADPLALGVRVWPQAIPQFLIGHLDRLAAAKSALGQGGYDGLFLGGNYVAGVALGRCIEGAYESASQVSDFLTKYAYK

SEQ ID NO: 114 - protein, 539 aa, Gossypium hirsutum
  VARIANT (137)..(137): Xaa can be any naturally occurring amino acid
  VARIANT (156)..(156)
  VARIANT (168)..(168): Xaa can be any naturally occurring amino acid
MTALIDLSLLRSSPSVSPFSIPHHQLPPRSRKPFRLRCSVAEGPTISSSKIDGGESSIADCVVVGGGISGLCIAQALATKHRDVASNVIVTEARDRVGGNITTVERDGYLWEEGPNSFQPSDPILTMAVDSGLKDDXVLGDPNAPRFVLWEGKLRXVPSKPTDLPFFXLMSIAGKLRAGFGAIGIRPPPPGYEESVEEFVRRNLGAEVFERFIEPFCSGVYAGDPSKLSMKAAFGRVWKLEEIGGSIIGGTFKTIQERNKTPKPPRDPRLPKPKGQTVGSFRKGLTMLPEAIANSLGSNVKLSWKLSSITKLGNGGYNLTFETPEGMVSLQSRSVVMTIPSHVASNLLHPLSAAAADALSQFYYPPVASVTVSYPKEAIRKECLIDGELKGFGQLHPRSQGIETLGTIYSSSLFPNRAPSGRVLLLNYIGGATNTGILSKTEGELVEAVDRDLRKMLINPNAKDPLVLGVRVWPKAIPQFLVGHLDLLDSAKMALRDSGFHGLFLGGNYVSGVALGRCVEGAYEVAAEVKEFLSQYAYK

SEQ ID NO: 115 - protein, 503 aa, Gossypium hirsutum
MASTENKDDHSSAKRVAVIGAGVSGLAAAYKLKSQGLHVTVFESEGRAGGKLRSVSRDGLIWDEGANTMTESEIEVRSLFDDLGIQDKQQVPIAQNKRYIMRNGVPVLIPSNPLSLFTSSILSAKSKFQIILEPFLWRNSEASKVSDAYNQESVGGFFQRHFGQEVVDYLVDPFVAGTSAGDPESLSMCHSFPGLWDLEQRFGSIIVGAVKSKFSAKRTNREETKNSVKRKALRGSFSFKGGMQTLADMLCKDLSKDELKLKSKVLSLSYSHEGKSTSENWSLSYASDRDKRSQGSSFDAVIMTAPVCNVKEMKITKGGNVFPLNFIPEVSYMPLSVIITAFKKENVKKPLEGFGVLIPSKEQQNGLKTLGTLFSSVMFPDRAPNNLYLYTTFVGGNRNEKLAKASTDELKHIVTSDLQQLLGVEGEPTFFNHFYWSKAFPLYGRNYASVLEGIEKMERDLPGFFYAGNHKGGLSVGKSIASGCKAADNVITYLESSHDKLLK

SEQ ID NO: 116 - protein, 560 aa, Beta vulgaris
MKSMALSNCIPQTQCMPLHSSGHYRGNCIMLSIPCSLIGRRGYYSHKKRRMSMSCSTSSGSKSAVKEAGSGSGSGAGGLLDCVIVGGGISGLCIAQALCTKQSSLSPNFIVTEAKDRVGGNIVTVEADGYIWEEGPNSFQPSDAVLTMAVDSGLKDELVLGDPNAPRFVLWNDKLRPVPSSLTNLPFFDLMTIPGKIRAALGALGFRPSPPPHEESVEHFVRRNLGDEVFERLIEPFCSGVYAGDPAKLSMKAAFGKVWKLEQKGGSIIGGTLKAIQERGSNPKPPRDQRLPKPKGQTVGSFRKGLVMLPTAISARLGSRVKLSWTLSSIVKSLNGEYSLTYDTPDGLVSVRTKSVVMTVPSYVASRLLRPLSDSAADSLSKFYYPPVAAVSLSYPKEAIRSECLINGELQGFGQLHPRSQGVETLGTIYSSSLFPGRAPPGRILILSYIGGAKNPGILNKSKDELAETVDKDLRRMLINPDAKLPRVLGVRVWPQAIPQFSIGHFDLLDAAKAALTDTGVKGLFLGGNYVSGVALGRCIEGAYESAAEVVDFLSQYSDK

SEQ ID NO: 117 - protein, 508 aa, Brassica napus
MASNAVADHDKLSGKRVAVVGAGVSGLAAAYKLKSKGVNVTVFEADGRVGGKLRSVMHNGLIWDEGANTMTEAEPEVGSLLDDLGLREKQQFPLSQKKRYIVRNGLPVMIPTNPIALVTSSVLSTQSKFQILLEPFLWKKNDSSSKVSDASVVESVSGFFQRHFGQEVVDYLIDPFMGGTSAADPESLSMKHSFPDLWNIEKSFGSIIVGAIRSKFAAKGSKNGETKSSTGTKKGSRGSFSFKGGMQILPEMLCKDLSRDELNLDSKVLSLSYNAGPRQENWSLSCVSHNEAQGQNLHYDAVIMTAPLCNVKEMKVMKGGEPFKLNFLPEIKYMPLSVIITTFTKEKVKRPLEGFGVLIPTKEQKHGFKTLGTLFSSMMFPDRCPSDLHLYTTFIGGSRNQELAKASTDELKQVATSDLQRLLGVEGEPVFVNHVYWNKAFPLYDRSYDSVMEAIDKMEKDLPGFFYAGNHRGGLSVGKSIASGCKAADLVISYLESCSNDKKSEDSL

SEQ ID NO: 118 - DNA, 1638 bp, Triticum aestivum
atggggatccaccccgccgcactgacattcccccgagcgacagaaatggccggcgcaacaatggccaccgccaccgtcgcggccgcgtcgccgctccgcggcagggtcaccgggcgcccacaccgcgtccgcccgcgttgcgctaccgcgagcagcgcgaccgagactccggcggcgcccggcgtgcggctgtccgcggaatgcgtcattgtgggcgccggcatcagcggcctctgcaccgcgcaggcgctggccacccgatacggcgtcagcgacctgctcgtcacggaggcccgcgaccgcccgggcggcaacatcaccaccgtcgagcgtcccgacgaggggtacctgtgggaggagggacccaacagcttccagccctccgacccggtcctcaccatggccgtggacagcgggctcaaggatgacttggtgttcggggaccccaacgcgccccggttcgtgctgtgggaggggaagctgaggccggtgccgtcgaagccaggcgacctgcctttcttcagcctcatgagtatccctgggaagctcagggccggccttggcgcgctcggcattcgcccacctcctccagggcgcgaggagtcggtggaggagtttgtgcgccgcaacctcggtgccgaggtctttgagcgcctcatcgagcctttctgctcaggtgtatatgctggtgatccttcgaagcttagtatgaaggctgcatttgggaaggtctggaggttggaggagattggaggtagtattattggtggaaccatcaaggcgattcaggataaagggaagaaccccaaaccgccaagggatccccgacttccggcaccaaagggacagacggtggcatctttcaggaagggtctagccatgctcccgaatgccatcgcatctaggctgggtagtaaagtcaagctgtcatggaagcttacgagcattacaaaggcggacaaccaaggatatgtattaggttatgaaacaccagaaggacttgtttcagtgcaggctaaaagtgttatcatgaccatcccgtcatatgttgctagtgatatcttgcgcccactttcaattgatgcagcagatgcactctcaaaattctattatccgccagttgctgctgtaactgtttcatatccaaaagaagctattagaaaagaatgcttaattgatggggagctccagggtttcggccagttgcatccacgtagccaaggagtcgagactttagggacaatatatagctcttctctctttcctaatcgtgctcctgctggaagagtgttacttctgaactatatcgggggttctacaaatacagggatcgtctccaagactgagagtgacttagtaggagccgttgaccgtgacctcagaaaaatgttgataaaccctagagcagcagaccctttagcattaggggttcgagtgtggccacaagcaataccacagtttttgattgggcaccttgatcgccttgctgctgcaaaatctgcactgggccaaggcggctacgacgggmtgttcctaggaggaaactacgtmgcaggagttgccttgggccgatgcatcgagggtgcgtacgagagtgcctcacaagtatctgacttcttgaccaagtatgcctacaag

SEQ ID NO: 119 - DNA, 1617 bp, Gossypium hirsutum
  misc_feature (411)..(411): /note="n is a, c, g, or t"
  misc_feature (447)..(447): /note="n is a, c, g, or t"
  misc_feature (467)..(467): /note="n is a, c, g, or t"
  misc_feature (504)..(504): /note="n is a, c, g, or t"
  misc_feature (564)..(564): /note="n is a, c, g, or t"
  misc_feature (918)..(918): /note="n is a, c, g, or t"
  misc_feature (939)..(939): /note="n is a, c, g, or t"
  misc_feature (1008)..(1008): /note="n is a, c, g, or t"
atgacggctctaatcgacctttctcttctccgctcctcgccctccgtttcccctttctccataccccaccaccagcttccgccccgctctcgtaaacctttcaggctccgatgctccgtcgccgagggtcccacgatttcctcatctaaaatcgacgggggagaatcatccatcgcggattgcgtcgtcgttggaggtggtatcagtggactttgcattgctcaagctctcgccaccaagcaccgtgacgtcgcttccaatgtgattgtgacggaagccagagaccgtgttggtggcaacatcactaccgttgagagagatggatatctgtgggaagaaggccccaacagttttcagccctccgatcctattctaaccatggccgtggatagtggattgaaggacgatttngttttaggtgaccctaatgcaccgcgatttgtactntgggagggaaaactaaggcntgtgccctccaagccaaccgacttgccgttttttganttgatgagcattgctggaaaacttagggctgggttcggggctattggcattcggcctccncctccgggttatgaagaatcggtggaggagtttgtgcgccgtaatcttggtgctgaggtttttgaacgctttattgaaccattttgttcaggtgtttatgcaggggatccttcaaaattaagcatgaaagcagcatttggaagagtatggaagctagaagagattggtggcagcatcattggtggcactttcaagacaatccaggagagaaataagacacctaagccacccagagacccgcgtctgccaaaaccgaagggccaaacagttggatcttttaggaagggacttaccatgctgcctgaggcaattgctaacagtttgggtagcaatgtaaaattatcttggaagctntccagtattaccaaattgggnaatggagggtataacttgacatttgaaacacctgaaggaatggtatctcttcagagtagaagtgttgtnatgaccattccatcccatgttgccagtaacttgttgcatcctctctcggctgctgctgcagatgcattatcccaattttattatcctccagttgcatcagtcacagtctcctatccaaaagaagccattcgaaaagaatgtttgattgatggtgaacttaaggggtttggccagttgcacccacgcagccaaggaattgaaactttagggacgatatacagttcatcacttttccccaatcgagctccatctggcagggtgttgctcttgaactacataggaggagctaccaacactggaattttgtccaagactgaaggggaacttgtagaagcagttgatcgtgatttgagaaaaatgcttataaatcctaatgcaaaggatcctcttgttttgggtgtaagagtatggccaaaagccattccacagttcttggttggtcatttggatctccttgatagtgcaaaaatggctctcagggattctgggtttcatggactgtttcttgggggcaactatgtatctggtgtggcattaggacggtgtgtggaaggtgcttacgaggttgcagctgaagtgaaggaattcctgtcacaatatgcatacaaa

SEQ ID NO: 120 - DNA, 1509 bp, Gossypium hirsutum
  misc_feature (630)..(630): /note="n is a, c, g, or t"
atggcgtcaactgaaaacaaagatgaccactcttctgctaaaagagtagctgtcattggcgctggtgttagtggactcgcggcagcttacaagttgaaatcacaaggtttacatgttacggtatttgaatctgaaggaagagctggagggaagttaagaagtgtttcgagggatggtttgatatgggatgaaggagcaaatacaatgactgaaagtgagattgaagtgagaagtttgtttgatgatcttggtattcaagataagcaacaagttccaattgcacagaacaagcggtatatcatgagaaatggcgtgcctgtattgatcccctcaaatcctctctcattattcacaagcagcattctttcagcaaaatcgaagtttcagattattttggagccttttctgtggagaaacagtgaagcctcaaaagtatctgatgcttataatcaggaaagtgtgggaggattttttcagcgccattttgggcaggaggttgtggattaccttgttgatccctttgttgctggcacaagtgctggagatcctgaatctctatctatgtgccattcctttccggggctatgggatcttgagcaaaggtttggctctatcattgttggagcagtnaaatctaaattctctgccaaaaggacaaatcgtgaagaaacaaaaaattcagtgaaaagaaaggctctacgtggctcattttccttcaagggtggaatgcagacacttgctgatatgttgtgcaaagatctttccaaagatgagcttaaactgaaatcaaaggttttgtcattatcttacagtcatgaggggaagtctacatcagagaactggtctctctcttatgcttctgatcgagacaagcgctcacaaggctcatcatttgatgctgtaataatgacggctccggtgtgcaatgttaaagaaatgaaaattactaaaggaggaaatgtctttccactgaacttcatccctgaggtgagttatatgccactatccgtcataattactgcttttaagaaggagaatgtcaagaaacccctagaaggttttggagttcttataccttcaaaggagcagcaaaatggtttaaaaactctcggtacacttttttcatctgtgatgtttcctgatcgtgcacctaataatttgtatctctatacaacctttgttggaggaaatcgaaatgagaagctggcaaaagcctcaacagatgaattgaagcatattgttacttccgaccttcagcagttgttgggagtggagggagaaccgacattcttcaatcatttctattggagcaaggcatttcccttgtatggccgtaactatgcttcggtcttggaaggcattgaaaagatggagagagatctccctggattcttctatgcaggtaaccacaaagggggattatcggtgggcaaatcgattgcttctggttgcaaagcagcagataatgtaattacatatttggaatcttcacatgacaagctgctgaaa

SEQ ID NO: 121 - DNA, 1680 bp, Beta vulgaris
atgaaatcaatggcgttatcaaactgcattccacagacacagtgcatgccattgcacagcagcgggcattacaggggcaattgtatcatgttgtcaattccatgtagtttaattggaagacgaggttattattcacataagaagaggaggatgagcatgagttgcagcacaagctcaggctcaaagtcagcggttaaagaagcaggatcaggatcaggatcaggagcaggaggattgctagactgcgtaatcgttggaggtggaattagcgggctttgcatcgcgcaggctctttgtacaaaacagtcctctttatccccaaattttatagtgacagaggccaaagacagagttggcggcaacatcgtcactgtggaggccgatggctatatctgggaggagggacccaatagcttccagccttccgacgcggtgctcaccatggcggtcgacagtggcttgaaagatgagttggtgctcggagatcccaatgctcctcgctttgtgctgtggaatgacaaattaaggcccgtaccttccagtctcaccaacctccctttcttcgacctcatgaccattcccggcaagattagggctgctcttggtgctctcggatttcgcccttctcctccacctcatgaggaatctgttgaacactttgtgcgtcgtaatctcggagatgaggtctttgaacgcttgattgaacccttttgttcaggtgtgtatgccggtgatcctgccaagctgagtatgaaagctgcttttgggaaggtctggaagttggagcaaaagggtggcagcataattggtggcactctcaaagctatacaggaaagagggagtaatcctaagccgccccgtgaccagcgcctccctaaaccaaagggtcagactgttggatcctttagaaagggactcgttatgttgcctaccgccatttctgctcgacttggcagtagagtgaaactatcttggaccctttctagtatcgtaaagtcactcaatggagaatatagtctgacttatgataccccagatggcttggtttctgtaagaaccaaaagtgttgtgatgactgtcccatcatatgttgcaagtaggcttcttcgtccactttcagactctgctgcagattctctttcaaaattttactatccaccagttgcagcagtgtcactttcctatcctaaagaagcgatcagatcagaatgcttgattaatggtgaacttcaaggtttcgggcaactacatccccgcagtcagggtgtggaaaccttgggaacaatttatagttcgtctcttttccctggtcgagcaccacctggtaggatcttgatcttgagctacatcggaggtgctaaaaatcctggcatattaaacaagtcgaaagatgaacttgccgagacagttgacaaggacctgagaagaatgcttataaatcctgatgcaaaacttcctcgtgtactgggtgtgagagtatggcctcaagcaataccccagttttctattgggcactttgatctgctcgatgctgcaaaagctgctctgacagatacaggggtcaaaggactgtttcttggtggcaactatgtttcaggtgttgccttggggcggtgtatagagggtgcttatgagtctgcagctgaggtagtagatttcctctcacagtactcagacaaa

SEQ ID NO: 122 - DNA, 1593 bp, Hordeum vulgare
atggccggtgcaggtgcaaccatggccaccgccaccgcgccgccgctccgcggcagggtcacccggcgcccgcacggcgtccgcccgcgttgcgcggccgcgggcagcgcgaccgagacccccgcggcgcccggcgtgcgtctgtccgcggactgcgtcatcgtgggcgccggcatcagcggcctctgcaccgcgcaggcgctggccacccggcacggcgtcggcgacctgctcgtcacggaggcccgcgaccgcccgggcggcaacatcaccaccgtcgagcgccccgacgaggggtacctctgggaggagggccccaacagcttccagccctccgaccccgtcctcaccatggccgtggacagcgggctcaaggatgacctggtgttcggggaccccaacgcgccccggttcgtgctgtgggaggggaagctgaggccggtgccgtccaagccaggcgacctgccgttcttcagcctcatgagcgtccccgggaagctcagggccggcctcggcgccctcggcattcgcccgcctcctccagggcgcgaggagtcggtggaggagtttgtgcgccgcaacctcggtgccgaggtctttgagcgccttatcgaacctttctgctcaggtgtgtatgctggtgatccttcgaagctcagtatgaaggctgcatttgggaaggtttggaggttggaggagattgggggtagtattattggtggaaccatcaaggcaattcaggataaagggaagaaccccaaaccgccaagggatccccgacttccggcaccaaagggacagacggtggcatctttcaggaagggtctggccatgctcccgaatgccatcgcatctaggttgggtagtaaagtcaagctgtcatggaagcttacgagcattacaaaggcggacaaccaaggatatgtattaggttatgaaacaccagaaggacttgtttcagtgcaggctaaaagtgttatcatgaccatcccgtcatatgttgctagtgatatcttacgcccactttcaattgatgcagcagatgcactctcaaaattctattatccgccagttgctgctgtaactgtttcatatccaaaagaagctattagaaaagaatgcttaattgatggggagctccagggtttcggccagctgcatccacgtagccaaggagtcgagactttagggacaatatatagctcttctctctttcccaatcgtgctcctgctggaagagtgttacttctgaactatatcgggggttctacaaatacagggatcgtctccaagaccgagagtgacttagtagaagctgttgatcgtgatctcagaaaaatgttgataaaccctagagcagcagaccctttagcattaggggtcagagtgtggccacaagcaataccacagtttttgattggacaccttgatcgccttgctgctgcaaaatctgcactgggccgaggcgggtacgacgggttattcctaggaggaaactacgtagcaggagttgccttgggccgatgcatcgagggtgcgtacgagagtgcctcacaagtatctgacttcttgaccaagtatgcctacaagtga

SEQ ID NO: 123 - DNA, 1665 bp, Hordeum vulgare
atgctcacttccgccaccgctcccccctcctcctcctcctgctcgtcccacgctcccgcccgcttcgcctccccgtcccggccccgtcgctccgcgtccgcgtccgcgcgcgggcgagggcgccgcgtccgccccgtgctcgccatggccgcctccgacgacccccgcgccaggtcggtcgccgtcgtcggcgccggcgtcagtgggctcgtggcggcgtacatgctgaggaagagcggcgtgcgggtcaccgtgttcgaggcggaagaccgcgcgggagggaagatacggaccaactccgacggcggattcctctgggacgaaggagccaacaccatgacagaaagtgcactggaggctagtaggctaatcgacgatcttggtcttcaggacagactgcagtatcctaactcccagcacaagcgttacaccgttaaggatggggcgccagcactgattccttcagatcccattgcgctaatgaaaagcactgttctttctacgaaatcaaagttcaagttatttctggaaccatttctctatgaaaaatctagcacaaggaactccaaaaaagtgtctgacgagcatttgcgcgagagcgttgggagtttttttgaacgccattttgggaaagaggttgttgactatcttattgatccatttgtagctggaacaagtgcaggagatcccgagtcattatctattcgtcatgcatttccggggttatggaatttagaaaaaaagtatggttctctcatcgttggtgccatcttgtcaaaactaacagctaaaggtggttcagcaaagaaaggaggcgcttcgtcaggaaaaggaaggaacaagcgggcctcattttcatttcatggtggcatgcagacactagtagacgcacttcacaaggaagttggagatactaatgtgaagcttggaacacaagtattgtcattggcgtgtaactgtgatggactctctgcatcagatgggtggtcaatttttgttgattcaaaggatgctagtagtaaggagcttgcaaggaaccaatcctttgatgctgttataatgacagctccactgtccaatgtccagaggatgaagttcacaaaaggcggacgtccctttgtgctagactttcttcctaaggtggattatctgccgttgtccctcatggtaacagcatttaagaaggaagacgtcaaaagacccctcgaaggatttggggtcttaataccctttaaggaacaacaaaaacatggtttgaaaacgctcggaactctcttctcctctatgatgttcccagatcgagctcctaatgaccagcacttgtttacaacattcattgggggaagccacaatagagatctcgctggagctccaacggctatcttgaaacaatttgtgacatctgaccttacaaagctactgggggtagaggggcagccaacttttgtgaaacatatacattggagaaatgcttttcctttgtatggccatgattatgatttggcactggaagctataggaaagatggaaggtgatctcccagggttcttctatgcaggaaataacaaggatgggttggctgttggaaatgtcatagcttcaggaagtaacactgcagaccttgtgatctcataccttgagtcaggcatcaagcatgttaattga

SEQ ID NO: 124 - DNA, 1593 bp, Triticum aestivum
atggccggcgcaacaatggccaccgccaccgtcgcggccgcgtcgccgctccgcggcagggtcaccgggcgcccacaccgcgtccgcccgcgttgcgctaccgcgagcagcgcgaccgagactccggcggcgcccggcgtgcggctgtccgcggaatgcgtcattgtgggcgccggcatcagcggcctctgcaccgcgcaggcgctggccacccgatacggcgtcagcgacctgctcgtcacggaggcccgcgaccgcccgggcggcaacatcaccaccgtcgagcgtcccgacgaggggtacctgtgggaggagggacccaacagcttccagccctccgacccggtcctcaccatggccgtggacagcgggctcaaggatgacttggtgttcggggaccccaacgcgccccggttcgtgctgtgggaggggaagctgaggccggtgccgtcgaagccaggcgacctgcctttcttcagcctcatgagtatccctgggaagctcagggccggccttggcgcgctcggcattcgcccacctcctccagggcgcgaggagtcggtggaggagtttgtgcgccgcaacctcggtgccgaggtctttgagcgcctcatcgagcctttctgctcaggtgtatatgctggtgatccttcgaagcttagtatgaaggctgcatttgggaaggtctggaggttggaggagattggaggtagtattattggtggaaccatcaaggcgattcaggataaagggaagaaccccaaaccgccaagggatccccgacttccggcaccaaagggacagacggtggcatctttcaggaagggtctagccatgctcccgaatgccatcgcatctaggctgggtagtaaagtcaagctgtcatggaagcttacgagcattacaaaggcggacaaccaaggatatgtattaggttatgaaacaccagaaggacttgtttcagtgcaggctaaaagtgttatcatgaccatcccgtcatatgttgctagtgatatcttgcgcccactttcaattgatgcagcagatgcactctcaaaattctattatccgccagttgctgctgtaactgtttcatatccaaaagaagctattagaaaagaatgcttaattgatggggagctccagggtttcggccagttgcatccacgtagccaaggagtcgagactttagggacaatatatagctcttctctctttcctaatcgtgctcctgctggaagagtgttacttctgaactatatcgggggttctacaaatacagggatcgtctccaagactgagagtgacttagtaggagccgttgaccgtgacctcagaaaaatgttgataaaccctagagcagcagaccctttagcattaggggttcgagtgtggccacaagcaataccacagtttttgattgggcaccttgatcgccttgctgctgcaaaatctgcactgggccaaggcggctacgacgggttgttcctaggaggaaactacgtcgcaggagttgccttgggccgatgcatcgagggtgcgtacgagagtgcctcacaagtatctgacttcttgaccaagtatgcctacaag

SEQ ID NO: 125 - DNA, 1506 bp, Solanum lycopersicum
atggctccatctgccggagaagataaacaaaagagagttgcagtcattggtgctggcgtcagtggacttgctgcagcatacaagttgaaagttcatggcttgaatgtcacagtatttgaagcagaagggagagctggagggaagttacgaagcctgagtcaagatggcctaatatgggatgaaggcgcaaatactatgactgaaagtgaaggtgatgtcacatttttgcttgattcgcttggactccgagaaaaacaacaattcccactttcacagaacaagcgctacattgccagaaatggtactcctactctgataccttcaaatccatttgacctattcaaaagcaattttctttccactggatcaaagcttcagatgcttttcgagccacttttgtggaagaataaaaagcttacaaaggtgtctgacaaacacgaaagtgtcagtggattcttccagcgtcattttggaaaggaggttgtcgactatctaattgacccttttgttgctggaacatgtggtggtgatcctgattcgctttcaatgcacctttcatttccagacttgtggaatttagagaaaaggtttggttcagtcatagttggggcaattcaatctaagttatctcctataaaggaaaagaaacaagggccacccagaacttcaataaataagaagcgccagcgggggtccttttcatttttgggcggaatgcaaacacttactgacgcaatatgcaaaaatctcaaagaagatgaacttaggctaaactctagagttctggaattatcttgtagctgtagtggggactctgcgatagatagctggtcaattttttctgcctctccacacaagcggcaagcagaagaagaatcatttgatgctgtaattatgacggcccctctctgtgacgttaagagtatgaagattgctaagagaggaaatccatttctgctcaactttattcctgaggtcgattatgtaccactatctgttgttataaccacatttaagaaggagagtgtaaagcatccccttgagggttttggagtgcttgtaccctcccaggagcaaaaacatggtctgaagacactaggcaccctcttctcttctatgatgtttccagatcgtgcacccaacaatgtctatctctatactacatttgttggtggaagccgaaatagagaactcgcgaaagcctcgaggactgagctgaaagagatagtaacttctgaccttaagcagttgttgggtgctgagggagagccaacatatgtgaatcatttatgctggagtaaagcatttccattgtacgggcataactatgattcagtcctagacgcaattgacaaaatggagaaaagccttcctggattattctatgcaggtaaccacaaggggggattgtcagttggcaaagcattatcttctggatgcaatgcagcagatcttgttatatcatatcttgaagcggtttcagctgacaccaaaaaccatagctga

SEQ ID NO: 126 - DNA, 1677 bp, Solanum lycopersicum
atgacaacaacggccgtcgtcaaccatcctagcattttcactcaccggtcgccgctgccgtcgccgtcctcctcctcatcctcatcgccgtcatttttatttttaaatcgtacgaattttattccatacttttccacctccaagcgcagtagtgtcaattgcaatggctggagaacacggtgttccgttgcgaagaattatacagttcctccctcagaagttgacggtaatcagttaccggagctggattgtgtggtagtcggagcaggaattagtggtctctgcattgctaaggtgatatcggctaattatcccaatttgatggtgacggaggcgagggatcgtgccggtggaaacataacgacggtggaaagagatggatacttatgggaagaaggtcctaacagtttccagccttcggatcctatgttgactatggctgtagattgtggattgaaggatgatttggtgttgggagatcctgatgcgcctcgctttgtcttgtggaaggataaactaaggcctgttcccggcaagctcactgatcttcccttctttgatttgatgagtattcctggcaagctcagagctggttttggtgccattggccttcgcccttcacctccaggttatgaggaatcagttgagcagttcgtgcgtcgtaatcttggtgctgaagtctttgaacgtttgattgaaccattttgttctggtgtttatgctggcgacccatcaaaattgagtatgaaagcagcatttgggaaagtgtggaagctagaacaaactggtggtagcattattgggggaacctttaaggcaataaaggagagatccagtaaccctaaaccgcctcgtgatccgcgtttaccaacaccaaaaggacaaactgttggttcatttaggaagggtctgagaatgctgccagatgcaatttgtgaaagactgggaagcaaagtgaaactatcatggaagctttctagcattacaaagtcagataaaggaggatatctcttgacatacgagacaccagaaggagtagtttctctgcgaagtcgaagcattgtcatgactgttccatcctatgtagcaagcaacatattacgccctctttcggtcgccgcagcagatgcactttcaagtttctactatcccccagttgcagcagtgacaatttcatatcctcaagaggctattcgtgatgagcgtctggttgatggtgaactaaagggatttgggcagttgcatccacgttcacagggagtggaaacactaggaacaatatatagttcatcactcttccctaaccgtgctccaaatggccgggtgctactcttgaactacattggaggagcaacaaatactgaaattgtgtctaagacagagagccaacttgtggaagcagttgaccgtgacctcagaaagatgcttataaaacccaaagcacaagatccctttgttacgggtgtgcgagtatggccacaagctatcccacagtttttggtcggacatctggatacactaggtactgctaaagctgctctaagtgataatgggcttgacgggctattccttgggggtaattatgtgtctggtgtagcattgggaaggtgtgttgaaggtgcttatgaaattgcatctgaagtaactgggtttctgtctcagtatgcatacaaatga

SEQ ID NO: 127 - DNA, 1620 bp, Gossypium hirsutum
atgacggctctaatcgacctttctcttctccgctcctcgccctccgtttcccctttctccataccccaccaccagcttccgccccgctctcgtaaacctttcaagctccgatgctccctcgccgagggtcccacgatttcctcatctaaaatcgacgggggagaatcatccatcgcggattgcgtcgtcgttggaggtggtatcagtggactttgcattgctcaagctctcgccaccaagcaccgtgacgtcgcttccaatgtgattgtgacggaagccagagaccgtgttggtggcaacatcactaccgttgagagagatggatatctgtgggaagaaggacccaacagttttcagccctccgatcctattctaaccatggccgtggatagtggattgaaggacgatttagttttaggtgaccctaatgcaccgcgatttgtactgtgggagggaaaactaaggcctgtgccctccaagccaaccgacttgccgttttttgacttgatgagcattgctggaaaacttagggctgggttcggggctattggcattcggcctccccctccgggttatgaagaatcggtggaggagtttgtgcgccgtaatcttggtgctgaggtttttgaacgctttattgaaccattttgttcaggtgtttatgcaggggatccttcaaaattaagcatgaaagcagcatttggaagagtatggaagctagaagagattggtggcagcatcattggtggcactttcaagacaatccaggagagaaataagacacctaagccacccagagacccgcgtctgccaaaaccgaagggccaaacagttggatcttttaggaagggacttaccatgctgcctgaggcaattgctaacagtttgggtagcaatgtaaaattatcttggaagctctccagtattaccaaattgggtaatggagggtataacttgacatttgaaacacctgaaggaatggtatctcttcagagtagaagtgttgtcatgaccattccatcccatgttgccagtaacttgttgcatcctctctcggctgctgctgcagatgcattatcccaattttattatcctccagttgcatcagtcacagtctcctatccaaaagaagccattcgaaaagaatgtttgattgatggtgaacttaaggggtttggccagttgcacccacgcagccaaggaatcgaaactttagggacgatatacagttcatcacttttccccaatcgagctccatctggcagggtgttgctcttgaactacataggaggagctaccaacactggaattttgtccaagactgaaggggaacttgtagaagcagttgatcgtgatttgagaaaaatgcttataaatcctaatgcaaaggatcctcttgttttgggtgtaagagtatggccaaaagccattccacagttcttggttggtcatctggatctccttgatactgcaaaaatggctctcagggattctgggtttcatggactgtttcttgggggcaactatgtatctggtgtggcattaggacggtgtgtggaaggtgcttacgaggttgcagctgaagtgaaggaattcctgtcacaatatgcatacaaataa

SEQ ID NO: 128 - DNA, 1683 bp, Beta vulgaris
atgaaatcaatggcgttatcaaactgcattccacagacacagtgcatgccattgcacagcagcgggcattacaggggcaattgtatcatgttgtcaattccatgtagtttaattggaagacgaggttattattcacataagaagaggaggatgagcatgagttgcagcacaagctcaggctcaaagtcagcggttaaagaagcaggatcaggatcaggatcaggagcaggaggattgctagactgcgtaatcgttggaggtggaattagcgggctttgcatcgcgcaggctctttgtacaaaacagtcctctttatccccaaattttatagtgacagaggccaaagacagagttggcggcaacatcgtcactgtggaggccgatggctatatctgggaggagggacccaatagcttccagccttccgacgcggtgctcaccatggcggtcgacagtggcttgaaagatgagttggtgctcggagatcccaatgctcctcgctttgtgctgtggaatgacaaattaaggcccgtaccttccagtctcaccgacctccctttcttcgacctcatgaccattcccggcaagattagggctgctcttggtgctctcggatttcgcccttctcctccacctcatgaggaatctgttgaacactttgtgcgtcgtaatctcggagatgaggtctttgaacgcttgattgaacccttttgttcaggtgtgtatgccggtgatcctgccaagctgagtatgaaagctgcttttgggaaggtctggaagttggagcaaaagggtggcagcataattggtggcactctcaaagctatacaggaaagagggagtaatcctaagccgccccgtgaccagcgcctccctaaaccaaagggtcagactgttggatcctttagaaagggactcgttatgttgcctaccgccatttctgctcgacttggcagtagagtgaaactatcttggaccctttctagtatcgtaaagtcactcaatggagaatatagtctgacttatgataccccagatggcttggtttctgtaagaaccaaaagtgttgtgatgactgtcccatcatatgttgcaagtaggcttcttcgtccactttcagactctgctgcagattctctttcaaaattttactatccaccagttgcagcagtgtcactttcctatcctaaagaagcgatcagatcagaatgcttgattaatggtgaacttcaaggtttcgggcaactacatccccgcagtcagggtgtggaaaccttgggaacaatttatagttcgtctcttttccctggtcgagcaccacctggtaggatcttgatcttgagctacatcggaggtgctaaaaatcctggcatattaaacaagtcgaaagatgaacttgccgagacagttgacaaggacctgagaagaatgcttataaatcctgatgcaaaacttcctcgtgtactgggtgtgagagtatggcctcaagcaataccccagttttctattgggcactttgatctgctcgatgctgcaaaagctgctctgacagatacaggggtcaaaggactgtttcttggtggcaactatgtttcaggtgttgccttggggcggtgtatagagggtgcttatgagtctgcagctgaggtagtagatttcctctcacagtactcagacaaatag

SEQ ID NO: 129 - protein, 98 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANT

SEQ ID NO: 130 - protein, 98 aa, Amaranthus
MVIQSITHLSPNLALPSPLSVSTKNYPVAVMGNISEREEPTSAKRVAVVGAGVSGLAAAYKLKSHGLSVTLFEANSRAGGKLKTVKKDGFIWDEGANT

SEQ ID NO: 131 - protein, 98 aa, Amaranthus
MVIQSITHLSPKLALPSPLSVSTKNYPVAVMGNISEREEPTSAKRVAVVGAGVSGLAAAYKLKSHGLNVTLFEADSRAGGKLKTVKKDGFIWDEGANT

SEQ ID NO: 132 - protein, 98 aa, Amaranthus; identical to SEQ ID NO: 131

SEQ ID NO: 133 - protein, 113 aa, Echinochloa
MLTLLFGVTSAGRATMVIQSTTHLSPNLALPSPLSVSTKNYPVAVMGNISEREEPTSAKRVAVVGAGVSGLAAAYKLKSHGLSVTLFEADSRAGGKLKTVKKDGFIWDEGANT

SEQ ID NO: 134 - protein, 97 aa, Spinacia oleracea
MVILPVSQLSTNLGLSLVSPTKNNPVMGNVSERNQVNQPISAKRVAVVGAGVSGLAAAYKLKSNGLNVTLFEADSRAGGKLKTVVKDGLIWDEGANT

SEQ ID NO: 135 - protein, 96 aa, Beta vulgaris subsp. vulgaris
MVMLYDSHLSGVSTHLQLSQAFPRKNPLMAKVSEPGKPTSAKRIAVVGAGVSGLAAAYKLKSHGLSVTLFEADTRAGGKLKTVAKDGLIWDEGANT

SEQ ID NO: 136 - protein, 94 aa, Solanum tuberosum
MAPSAGEDKQSNLLYPHVSLHNSTISQAKLTQFFCVDCPKRVAVIGAGVSGLAAAYKLKIHGLDVTVFEAEGRAGGKLRSLSQDGLIWDEGANT

SEQ ID NO: 137 - protein, 88 aa, Gossypium
MLNIAPSCVLASGISKPVTKMASTENKDDHSSAKRVAVIGAGVSGLAAAYKLKSQGLHVTVFESEGRAGGKLRSVSREGLIWDEGANT

SEQ ID NO: 138 - protein, 122 aa, Eucalyptus
MTGSTICSWKTRTVDGPNPELWSARRRRPPLSSLSISIGKPEQRGAHGQQRHAKMSSAAGADISSKTLHALSSSQLTYGLAAAHKLKSNGVDVTVYEAEGRIGGKLRSVSQGGLIWDEGANT

SEQ ID NO: 139 - protein, 72 aa, Coffea
MASPAPKEKDKSSTCTKKRVAVVGAGVSGLAAAYKLKLRGLNVTVFEADERAGGKLKSVSRDGLIWDEGANT

SEQ ID NO: 140 - protein, 71 aa, Arabidopsis thaliana
MASGAVADHQIEAVSGKRVAVVGAGVSGLAAAYKLKSRGLNVTVFEADGRVGGKLRSVMQNGLIWDEGANT

SEQ ID NO: 141 - protein, 68 aa, Helianthus annuus
MASPTTPDNQKPAKRVAVVGAGVSGCAAAYKLKLHGLNVTVFEADGRVGGKLRSVSQDGLIWDEGANT

SEQ ID NO: 142 - protein, 73 aa, Arabidopsis lyrata
MESGAVGDHDTKFESISGKRVAVVGAGVSGLAAAYKLKSRGLNVTVFEADERAGGKLTSVMQNGLIWDQGANT

SEQ ID NO: 143 - protein, 99 aa, Erythranthe
MRLYSAQYCCPSLLLLSSPSPYPFPITRSTVLSMASAAQQDSAVKSVAVIGAGVSGLSAAYKLKLHGLNVTVFEADARSGGKLRSISHDGLIWDEGANT

SEQ ID NO: 144 - protein, 69 aa, Brassica oleracea
MASNAAADHDKLSGKRVAVVGAGVSGLAAAYKLKSKGVNVTLFEADGRVGGKLRSVMHNGLIWDEGANT

SEQ ID NO: 145 - protein, 68 aa, Ambrosia artemisiifolia
MASPTIVDNQKPAKRVAIVGAGVSGCAAAYKLKLHGLNVTVFEADERVGGKPRSVSQDGLIWDEGANT

SEQ ID NO: 146 - protein, 71 aa, Morus notabilis
MGTSASKQDNPTSPVKSVAVIGAGVSGLAAAYKLKSHGLNVTVFEAEERAGGKLRSVSSHHGLIWDEGANT

SEQ ID NO: 147 - protein, 63 aa, Cucumis sativus
MKSSQSSRKKVAVVGAGVSGLAAAYKLKSHGFDVTVLEADERVGGKLRSVSYKGLIWDEGANT

SEQ ID NO: 148 - protein, 72 aa, Zostera marina
MSLPAMSEISCISTGPAHSVAVVGGGISGLAAAYKLKSNGLSVTVFETEERPGGKIRSRSQDGFIWDEGANT

SEQ ID NO: 149 - protein, 77 aa, Chondrus crispus
MAVAEGATPAPAAASATPSEVDALVIGSGISGSSLAFTLSQASPATSLLLTEARPVVGGNVISRNERGYTWEEGPNT

SEQ ID NO: 150 - protein, 66 aa, Chondrus crispus
MPEPVKRNVAVLGGGPAGLSAAFRLLHDLPPGLSVKVDLYEATGRLGGAVTSACDAGFCYELGPNS

SEQ ID NO: 151 - protein, 109 aa, Oryza nivara
MLSPATTFSSSSSSSSPSRAHARAPTRFAVVASARAARFRPARAMAASDDPRGGRSVAVVGAGVSGLAAAYRLRKRGVQVTVFEAADRAGGKIRTNSEGGFIWDEGANT

SEQ ID NO: 152 - protein, 108 aa, Oryza glumipatula
MLSPATTFSSSSSSSPSRAHAHAPTRFAVAASARAARFRPARAMAASDDPRGGRSVAVVGAGVSGLAAAYRLRKRGVQVTVFEAADRAGGKIRTNSEGGFIWDEGANT

SEQ ID NO: 153 - protein, 65 aa, Oryza
MAASDDPRGGRSVAVVGAGVSGLAAAYRLRKRGVQVTVFEAADRAGGKIRTNSEGGFIWDEGANT

SEQ ID NO: 154 - protein, 109 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANT

SEQ ID NO: 155 - protein, 114 aa, Oryza sativa
MAAAAAAMATATSATAAPPLRIRDAARRTRRRGHVRCAVASGAAEAPAAPGARVSADCVVVGGGISGLCTAQALATKHGVGDVLVTEARARPGGNITTAERAGEGYLWEEGPNS

SEQ ID NO: 156 - protein, 110 aa, Oryza punctata
MLSPATTTTFSSSSSSSSSSSRAHAPTRFAAAASARAARFRPARAMAASDDPHGGRSVAVVGAGVSGLAAAYRLRKRGVQVTVFEAADRAGGKIRTNSEGGFIWDEGANT

SEQ ID NO: 157 - protein, 108 aa, Oryza rufipogon
MLSPATTFSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANT

SEQ ID NO: 158 - protein, 113 aa, Oryza meridionalis
MLSPATATTTTTTTFSSSSSPSRAHAHASTRFAVAASARAARFRPARAMAASNDPRGGRSVAVVGAGVSGLAAAYRLRKRGVQVTVFEAADRAGGKIRTNSEGGFIWDEGANT

SEQ ID NO: 159 - protein, 100 aa, Zea mays
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANT

SEQ ID NO: 160 - protein, 109 aa, Oryza brachyantha
MLSPAATTTTTTSYCSYSSRAHAPTRSASAGAARFRPARAMATSDNDPRGAAPARSVAVVGAGVSGLAAAYKLRKRGVQVTVFEAADRAGGKIRTNSESGFIWDEGANT

SEQ ID NO: 161 - protein, 131 aa, Musa acuminata
MLKQHGSATNRGLLSKIWFARRFGEPVCRDPILLFRLPLDLGRSRRRRCSRKPSCFGEFHRQLAIAMASADNHNSIKSVAVVGGGVSGLAAAYKLKSNGLKVTLFEAEERAGGKIKSSSENGLIWDEGANT

SEQ ID NO: 162 - protein, 70 aa, Populus trichocarpa
MTAAAKDDDFGSKQSKNVAVIGAGVSGLAAAYKLKSNGVKVTVFEAEGRAGGKLRSVSHHDLVWDEGANT

SEQ ID NO: 163 - protein, 108 aa, Avena fatua
MLASATTPSPSSSRASTLFASSSRPRHTASARGRRLRPVLAMAASDDPRAAPARSVAVVGAGVSGLVAAYRLRKSGVRVTVFEADDRAGGKIRTNSDSGFLWDEGANT

SEQ ID NO: 164 - protein, 98 aa, Setaria italica
MLSSSTTTASPASSHPYRPAYPRASLRPVLAMAGSDDPRAAPARSVAVIGAGVSGLAAAYRLRKSGVNVTVFEAADRAGGKIRTNSEAGFLWDEGANT

SEQ ID NO: 165 - protein, 108 aa, Poa annua
MLTSATTPSSSSSASSRACARFASSARPHHTASARGRRLRPVLAMAASDQPRARSVAVVGAGVSGLVAAYRLRKSGVRVTVFEADDRAGGKIRTNSDSGFLWDEGANT

SEQ ID NO: 166 - protein, 100 aa, Sorghum bicolor
MLARTATVSSTSSHSHPYRPTSARSLRLRPVLAMAGSDDSRAAPARSVAVVGAGVSGLVAAYRLRKSGVNVTVFEAADRAGGKIRTNSEGGFLWDEGANT

SEQ ID NO: 167 - protein, 104 aa, Brachypodium distachyon
MLTSATASPSASTRFSSTCRPCRSDSVPARRPRPVLAMAASDDPRAAPARSVAVVGAGVSGLVAAHRLRKSGVRVTVFEADDRAGGKIRTNSDSGFLWDEGANT

SEQ ID NO: 168 - protein, 107 aa, Alopecurus myosuroides
MLTSATTPSSSSASSRASTRFASSSRPRRTASARGRRLRPVLAMAASDDPRARSVAVVGAGVSGLVAAYRLSKSGVRVTVFEADDRAGGKIRTNSDSGFLWDEGANT

SEQ ID NO: 169 - protein, 68 aa, Gossypium raimondii
MASTENKDDHSSAKRVAVIGAGVSGLAAAYKLKSQGLHVTVFESEGRAGGKLRSVSREGLIWDEGANT

SEQ ID NO: 170 - protein, 68 aa, Amaranthus tuberculatus
MGNISERDEPTSAKRVAVVGAGVSGLAAAYKLKSHGLNVTLFEADSRAGGKLKTVKKDGFIWDEGANT

SEQ ID NO: 171 - protein, 68 aa, Amaranthus tuberculatus; identical to SEQ ID NO: 170

SEQ ID NO: 172 - protein, 70 aa, Brassica rapa
MASNAVADHDKPVSGKRVAVVGAGVSGLAAAYKLKSKGVNVTVFEADGRVGGKLRSVMHNGLIWDEGANT

SEQ ID NO: 173 - protein, 70 aa, Jatropha curcas
MASAPKDERRNPSSGKRVAVVGAGVSGLAAAYKLKSHGLKVTVFEAEGRAGGKLRSVSRDGLIWDEGANT

SEQ ID NO: 174 - protein, 70 aa, Vitis vinifera
MAEKSDAQSHYNGSGKRVAVVGAGVSGLAAAYKLKLHGVNITLYEAEERAGGKLRSVSQHGLVWDEGANT

SEQ ID NO: 175 - protein, 69 aa, Vitis vinifera
MAEKSDAQSHYNGSGKRVAVVGAGVSGLAAAYKLKLHGVNTLYEAEERAGGKLRSVSQHGLVWDEGANT

SEQ ID NO: 176 - protein, 69 aa, Ricinus communis
MSSVIKEDRNPSHVKRVAVVGAGVSGLAAAYKLKSHGLKVTVFEAEERAGGKLRSVNHDGLIWDEGANT

SEQ ID NO: 177 - protein, 65 aa, Solanum lycopersicum
MAPSAGEDKQKRVAVIGAGVSGLAAAYKLKVHGLNVTVFEAEGRAGGKLRSLSQDGLIWDEGANT

SEQ ID NO: 178 - protein, 64 aa, Kochia
MADLSETSVKRVAVVGAGVSGLAAAYKLKSHGFNVTLFEAEPRAGGKIKTVAKDGLIWDEGANT

SEQ ID NO: 179 - protein, 66 aa, Prunus persica
MTSLTTKEGSVKRVAVVGAGVSGLAAAYKLKSHGFDVTVFEAEGRAGGKLRSVSHDGLIWDEGANT

SEQ ID NO: 180 - protein, 68 aa, Theobroma cacao
MAAAKNKDKQTSAKRVAVVGAGVSGLAAAYKLKSHGLNVTMFEAEGRAGGKLRSVSQEGLIWDEGANT

SEQ ID NO: 181 - protein, 68 aa, Glycine max
MASSATDDNPRSVKRVAVVGAGVSGLAAAYKLKSHGLDVTVFEAEGRAGGRLRSVSQDGLIWDEGANT

SEQ ID NO: 182 - protein, 68 aa, Citrus clementina
MASAPGEDNQRSAKRVAVVGAGVSGLAAAYKLKSNGVNVMVFEADERAGGKLRSISKDGLIWDEGANT

SEQ ID NO: 183 - protein, 68 aa, Citrus clementina
MTNKWRVDFSGSAKRVAVVGAGVSGLAAAYKLKSNGVNVMVFEADERAGGKLRSISKDGLIWDEGANT

SEQ ID NO: 184 - protein, 68 aa, Medicago truncatula
MASSAKDDNPRSVKRVAVVGAGVSGLAAAYKLKSHGLDVTVFEAEGRAGGRLRTVSRDGLVWDEGANT

SEQ ID NO: 185 - protein, 68 aa, Phaseolus vulgaris
MSSSATDDNPRSVKRVAVIGAGVSGLAAAYKLKSHGLDVTVFEAEGRAGGRLRSVSRDGLIWDEGANT

SEQ ID NO: 186 - protein, 68 aa, Vigna angularis
MSSSATDDNPRSVKRVAVIGAGVSGLAAAYKLKSHGVDVTVFEAEGRAGGRLRSVSRDGLIWDEGANT

SEQ ID NO: 187 - protein, 68 aa, Gossypium arboreum
MASTENKDDHSSAKRVAVIGAGVSGLAAAYKLKSQGLHVTVFESEGRAGGKLRSVSRDGLIWDEGANT

SEQ ID NO: 188 - protein, 68 aa, Nicotiana tabacum
MAPSAGEDKHSSAKRVAVIGAGVSGLAAAYKLKIHGLNVTVFEAEGKAGGKLRSVSQDGLIWDEGANT

SEQ ID NO: 189 - protein, 68 aa, Ambrosia artemisiifolia
MASPTIVDNQKPAKRVAIVGAGVSGCAAAYKLKLHGLNVTVFEADGRVGGKLRSVSQDGLIWDEGANT

SEQ ID NO: 190 - protein, 68 aa, Solanum tuberosum
MAPSAGEDKQNCPKRVAVIGAGVSGLAAAYKLKIHGLNVTVFEAEGRAGGKLRSLSQDGLIWDEGANT

SEQ ID NO: 191 - protein, 68 aa, Solanum tuberosum
MAPSAGEDKQNCPKRVAVIGAGVSGLAAAYKLKIHGLDVTVFEAEGRAGGKLRSLSQDGLIWDEGANT

SEQ ID NO: 192 - protein, 69 aa, Brassica napus
MASNAAADHDKLSGKRVAVVGAGVSGLAAAYKLKSKGVNVTVFEADGRVGGKLRSVIRNGLIWDEGANT

SEQ ID NO: 193 - protein, 69 aa, Brassica napus
MASNAVADHDKLSGKRVAVVGAGVSGLAAAYKLKSKGVNVTVFEADGRVGGKLRSVMHNGLIWDEGANT

SEQ ID NO: 194 - protein, 70 aa, Picea sitchensis
MAEHIHTDQNDKRPLKSVAVVGAGISGLAAAYRLKSQGLAVTIFEADGTTGGKIKSFAQNGLIWEKGANT

SEQ ID NO: 195 - protein, 67 aa, Brachypodium distachyon
MAASDDPRAAPARSVAVVGAGVSGLVAAHRLRKSGVRVTVFEADDRAGGKIRTNSDSGFLWDEGANT

SEQ ID NO: 196 - protein, 64 aa, Triticum aestivum
MAASDDPRARSVAVVGAGVSGLVAAYRLRKSGVRVTVFEAEDRAGGKIRTNSDGGFLWDEGANT

SEQ ID NO: 197 - protein, 65 aa, Oryza glaberrima; identical to SEQ ID NO: 153

SEQ ID NO: 198 - protein, 67 aa, Selaginella moellendorffii
MAMAEGETAPVLGSVAVVGAGASGLAAAYRLRAAGVSVTVYEAENSIGGKLKSVSENGFIWEKGPNT

SEQ ID NO: 199 - protein, 67 aa, Selaginella moellendorffii
MAMAEGETVPVLGSVAVVGAGASGLAAAYRLRAAGVSVTVYEAENSIGGKLKSVSENGFIWEKGPNT

SEQ ID NO: 200 - protein, 97 aa, Triticum aestivum
MLTSATAPSSSCSSHAPTRFASARGRRLRPVLAMAASDDPRARSVAVIGAGVSGLVAAYRLRKSGVRVTVFEAEDRAGGKIRTNSDGGFLWDEGANT

SEQ ID NO: 201 - protein, 112 aa, Hordeum vulgare
MLTSATAPPSSSSCSSHAPARFASPSRPRRSASASARGRGRRVRPVLAMAASDDPRARSVAVVGAGVSGLVAAYMLRKSGVRVTVFEAEDRAGGKIRTNSDGGFLWDEGANT

SEQ ID NO: 202 - protein, 70 aa, Ginkgo
MAAPLHPDNNSRRPHKSVAIVGAGISGLAAAYRLKSEGLAVTVFEAEESTGGKIKSISQDGLVWEKGPNT

SEQ ID NO: 203 - protein, 65 aa, Phytophthora capsici
MAARDVVVLGGGISGLTLAYFLRQALPKAAADATRIRVLDASAISGGWVHTAKREGFLFEEGPRG

SEQ ID NO: 204 - protein, 76 aa, Lemna
MEADAGKGSAGGAQILSHDSVRSVAVIGGGISGLAAAYKLKSNGFRAVVFEAEGKAGGKIRSGSQEGLIWDEGANT

SEQ ID NO: 205 - protein, 135 aa, Capsella rubella
MHDAGDSHDPFEIHKHVDVELKSGLDAKTLNKGPLDKRLKIIGPEELKTRFDAELSWLLLITMASAKVADNDTKFEAVSGRRVAVVGGGVSGLAAAYKLKSKGLNVTVFEADGRAGGKLRSVMHNGLIWDEGANT

SEQ ID NO: 206 - protein, 66 aa, Eutrema salsugineum
MAPDAVADHDKKFEALSGKRVAVVGAGVRLKSRGLNVTVFEADGRAGGKLRSVMHKGLIWDEGANT

SEQ ID NO: 207 - protein, 121 aa, Glycine max
MVSVFNEILFPPNQTLLRPSLHSPTSFFTSPTRKFPRSRPNPILRCSIAEESTASPPKTRDSAPVDCVVVGGGVSGLCIAQALATKHANANVVVTEARDRVGGNITTMERDGYLWEEGPNS

SEQ ID NO: 208 - protein, 117 aa, Gossypium raimondii
MTALIDLSLLRSSPSVSPFSIPHHQHPPRFRKPFKLRCSLAEGPTISSSKIDGGESSIADCVIVGGGISGLCIAQALATKHRDVASNVIVTEARDRVGGNITTVERDGYLWEEGPNS

SEQ ID NO: 209 - protein, 115 aa, Brassica napus
MDLSLLRPQPFLSPFSNPFPRSRPYKPLNLRCSVSGGSVVVGSSTIEGGGGGKTVAADCVIVGGGISGLCIAQALVTKHPDAAKSVMVTEAKDRVGGNIITREEQGFLWEEGPNS

SEQ ID NO: 210 - protein, 114 aa, Brassica napus
MDLSLLRPQPFLSPFSNPFPRSRPYKPLNLRCSVSGGSVVGSSTIEGGGGGKTVTADCVIVGGGISGLCIAQALVTKHPDAAKNVMVTEAKDRVGGNIITREEQGFLWEEGPNS

SEQ ID NO: 211 - protein, 62 aa, Bacteria <prokaryote>
MTRHVVILGGGVTGLAAAYRLRRTVPSPDDLAITLVERRSRLGGSIGTERHEGYLIESGVDS

SEQ ID NO: 212 - protein, 113 aa, Setaria italica
MVAAAMATAPSAGVPPLRGTRGPARFRIRGVSVRCAAVAGGAAEAPASAGARVSADCVVVGGGISGLCTAQALATKHGVGDVLVTEARARPGGNITTVERPDEGYLWEEGPNS

SEQ ID NO: 213 - protein, 115 aa, Zea mays
MVAATATATAMATAASPLLNGTRIPARLRHRGLSVRCAAVAGGAAEAPASTGARLSADCVVVGGGISGLCTAQALATRHGVGDVLVTEARARPGGNITTVERPEEGYLWEEGPNS

SEQ ID NO: 214 - protein, 109 aa, Triticum aestivum
MAGATMATATVAAASPLRGRVTGRPHRVRPRCATASSATETPAAPGVRLSAECVIVGAGISGLCTAQALATRYGVSDLLVTEARDRPGGNITTVERPDEGYLWEEGPNS

SEQ ID NO: 215 - protein, 109 aa, Brachypodium distachyon
MATATMATAAATAAPPRRLRVPAPPRGGHARCAVASNATEAPAAPGARLSADCVIVGGGISGLCTAQALATKYGFGDVLVTEARARPGGNITTVERPDEGYLWEEGPNS

SEQ ID NO: 216 - protein, 162 aa, Populus trichocarpa
MTVKQSSVARIKGLINPSSSQITSLQGSGSFACQTESEPAMTSTFTDLSLLRPTIPSLIPSSFSKFTTHRPLKLRCSLTEDSTTFIPFKLNGEAQSSAGHSATADCVIVGGGISGLCIAQALATKHWDVAPNVIVTEARDRVGGNITTLERDGYLWEEGPNS

SEQ ID NO: 217 - protein, 121 aa, Populus trichocarpa
MTTFIDFSLLRPTTPSLIPSSFSKFSTPRPFKLRCSLTEESATITPSKLNGEAQSNGGHSAAADCVIVGGGISGLCIAQALATKHRDVAPNVIVTEARDRVGGNITTLERDGYLWEEGPNS

SEQ ID NO: 218 - protein, 147 aa, Ginkgo
MAMAVEMEAVLTVALQNYPISPLKHFRGTHKKPATISSVFWQCKRNCLAGHAVWKGKTWIGGGVNVVAKEATMAPSGWVENENENDDMYDCVVVGGGISGLSTAQALVSKHSSTVKNVVLTEAKDRVGGNIMTMERDGYLWEEGPNS

SEQ ID NO: 219 - protein, 157 aa, Alopecurus myosuroides
MDFHTIRSPSLYPILVGHGKCKPTNQCSRSRIASSTPHRHLPRAQATEMVGATMAIATVTAALPLRVRVPGRSRRGQARCAVASDATEAPAAPSARLSADCVIVGGGISGLCTAQALATKYGVSDLLVTEARARPGGNITTVERPDEGYLWEEGPNS

SEQ ID NO: 220 - protein, 62 aa, Bacteria <prokaryote>
MKRVVVIGGGISGLSAAYFLKEAAAKKNIDLDYTLIEKSDRLGGNIITEKLDHFIVEGGPDN

SEQ ID NO: 221 - protein, 139 aa, Cyanidioschyzon merolae
MLRWSGSQQVTDRNRAEQHGLVVAFAFPARAPRHSEATHERWTGLAQRERGLCVPLKATKWKRDLWHSRKLQMQEPAQRNREQVQALVVGSGVTGSSFAFLLQHAGISDVICTEARGEVGGNLISRSKDGYLWEEGPNT

SEQ ID NO: 222 - protein, 128 aa, Amaranthus tuberculatus
MSAMALSSSILQCPPHSDISFRFFAHTRTQSPIFFGRPRKLSYIHCSTSSSSTANYQNTITSQGEGDKVLDCVIVGAGISGLCIAQALSTKHIQSNLNFIVTEAKHRVGGNITTMESDGYIWEEGPNS

SEQ ID NO: 223 - protein, 113 aa, Conyza canadensis
MTSLTNFTPLKLTNPNYLTTTTTYNHRKLSNFRFRCSIARDSPTAPSISGDSSSRPLLDCVVVGAGISGLCIAQALSTKHGGDVVVTEARERVGGNISTVERDGYLWEEGPNS

SEQ ID NO: 224 - protein, 121 aa, Lemna
MASSAAISPLHFSPAPPRRRELSHRCRVRCSIAGKPPATAANDSSATSVTGGEPVRRLRADCVIVGAGISGLCTAQALTVRPAAGRSSAPDVLVTEARDRVGGNITTVERDGYLWEEGPNS

SEQ ID NO: 225 - protein, 143 aa, Kochia
MSAMASPSIIPQSFLQRSPTSLQSRSNYSKNHIIISISTPCSHGKNQRRFLRKTTHFRSIHCSTISTSTPTSSSNPGTLGEGGLLDCVIVGGGISGLCIAQALSTKYSSLSTNFIVTEAKDRVGGNITTKEDDGYIWEEGPNS

SEQ ID NO: 226 - protein, 115 aa, Arabidopsis thaliana
MELSLLRPTTQSLLPSFSKPNLRLNVYKPLRLRCSVAGGPTVGSSKIEGGGGTTITTDCVIVGGGISGLCIAQALATKHPDAAPNLIVTEAKDRVGGNIITREENGFLWEEGPNS

SEQ ID NO: 227 - DNA, 639 bp, Artificial Sequence
  Expression cassette
atgactactgctgttactgctgctgtgtctttcccaagtaccaagaccacctctctcagtgctaggtctagttctgtgatctctcctgataagatctcttacaagaaggtgccactctactacagaaacgtgtcagctaccggaaagatgggacctatcagggctcaaatcgcttcttgctctagtatggatgctccttctgatgcattcctctgggtgaaggctctccacattatcgctgttgtttgctggttcgctgcactcttctacctccctagactctacgtgtaccacgctatgtctgaggatgatacctctcatagaaggttcgaggtgatggaaagaaagctctacaggggtatcatgtggccatctatgatcgctactctcatcaccgctcactttctcgtggattggggagatgctactagacactaccatgaggcactctggttctacatcaaggttggacttgttggactcctcgtgatctaccatttcgtgtgcggttactatagaaagaagctcatcggaaacgctcactacaagtctcacaagttttggagatacttcaacgagatgcctaccctcatcctcttcgctgtggttatcctcgttgtggtgaagcctcaattctga

SEQ ID NO: 228 - DNA, 747 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgctaacactatggatgccccatccgatgctttcttgtgggttaaggctctccacattatcgctgtggtttgctggttcgctgcactcttctaccttccaaggctttacgtgtaccacgccatgtctgaggatgacacctctcatagaaggttcgaggtgatggaacgtaagctctacaggggcattatgtggccatccatgattgccacccttattaccgctcacttcctcgtggattggggagatgctactaggcattaccatgaggccctctggttctacattaaggtgggattggtgggactcctcgtgatctaccatttcgtgtgcggctactaccgtaagaagctcattggaaacgcccactacaagagccacaagttttggagatacttcaacgagatgcccaccctgattcttttcgccgtggttattcttgtggtggtgaagccacagttctag

SEQ ID NO: 229 - DNA, 1086 bp, Artificial Sequence
  Expression cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatccatgaagccagatgctcatcaggtgaagcagttcttgcttaacctccaggataccatctgccagcagttgactgctgttgatggtgctgagttcgttgaggattcttggcaaagggaagctggtggtggtggaaggtctagagttcttagaaacggtggtgttttcgagcaggctggcgtgaacttctctcatgttcatggtgaagctatgccagcttctgctactgctcatagaccagagcttgccggaagatctttcgaggctatgggagtttctcttgtggtgcatccacacaacccatacgttccaacctctcacgcaaacgtgagattcttcattgctgagaagccaggcgctgatccagtttggtggttcggtggtggattcgatcttaccccattctacggcttcgaagaggatgctattcattggcataggaccgctagggatctttgccttccattcggagaggatgtgtaccccaggtacaagaagtggtgcgacgagtacttctacctcaagcacagaaacgagcagaggggaattggaggcctcttcttcgatgatctcaacaccccagatttcgaccgttgcttcgctttcatgcaggctgttggaaagggatacaccgatgcttacctccccatcgttgagagaagaaaggctatggcttacggcgagagagagaggaacttccaactttacagacgtggccgttacgttgagttcaaccttgtttgggatcgtggaacccttttcggacttcaaactggtggtaggaccgagtccatcctcatgtctatgccaccacttgttaggtgggagtacgactaccaacctaaggatggatctccagaggctgctctctccgagttcattaaggttagggattgggtgtga

SEQ ID NO: 230 - DNA, 1194 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgccaacactatgaagccagatgctcatcaggtgaagcagttcttgcttaacctccaggataccatctgccagcagcttactgctgttgatggtgctgagttcgttgaggattcttggcaaagggaagctggtggtggtggaaggtctagagttcttagaaacggtggtgttttcgagcaggctggcgtgaacttctctcatgttcatggtgaagctatgccagcttctgctactgctcatagaccagagcttgccggaagatcattcgaggctatgggagtttctcttgtggtgcatccacacaacccatacgttccaacctctcacgcaaacgtgagattcttcattgctgagaagccaggcgctgatccagtttggtggttcggtggtggattcgatcttaccccattctacggcttcgaagaggatgctattcattggcataggaccgctagggatctttgccttccattcggagaggatgtgtaccccaggtacaagaagtggtgcgacgagtacttctacctcaagcacagaaacgagcagaggggaattggaggcctcttcttcgatgatctcaacaccccagatttcgaccgttgcttcgctttcatgcaggctgttggaaagggatacaccgatgcttacctccccatcgttgagagaagaaaggctatggcttacggcgagcgtgagagaaacttccaactttacagacgtggccgttacgttgagttcaaccttgtttgggataggggaaccctcttcggacttcaaactggtggaagaaccgagtccatcctcatgtctatgccaccacttgttaggtgggagtacgactaccaacctaaggatggatctccagaggctgctctctccgagttcattaaggttagggattgggtgtga

SEQ ID NO: 231 - DNA, 999 bp, Artificial Sequence
  Expression Cassette
atggttattcagtctattacccacctctccccaaacctcgctttgccatctccactttctgtgtccaccaagaactacccagttgccgtgtgctcatccatgaagccagatgctcatcaggtgaagcagttcttgcttaacctccaggataccatctgccagcagcttactgctgttgatggtgctgagttcgttgaggattcttggcaaagggaagctggtggtggtggaaggtctagagttcttagaaacggtggtgttttcgagcaggctggcgtgaacttctctcatgttcatggtgaagctatgccagcttctgctactgctcatagaccagagcttgccggaagatctttcgaggctatgggagtttctcttgtggtgcatccacacaacccatacgttccaacctctcacgcaaacgtgagattcttcattgctgagaagccaggcgctgatccagtttggtggttcggtggtggattcgatcttaccccattctacggcttcgaagaggatgctattcattggcataggaccgctagggatctttgccttccattcggagaggatgtgtaccccaggtacaagaagtggtgcgacgagtacttctacctcaagcacagaaacgagcagaggggaattggaggcctcttcttcgatgatctcaacaccccagatttcgaccgttgcttcgctttcatgcaggctgttggaaagggatacaccgatgcttacctccccatcgttgagagaagaaaggctatggcttacggcgagagagagaggaacttccaactttacagacgtggccgttacgttgagttcaaccttgtttgggataggggaacccttttcggacttcaaactggtggtaggaccgagtccatcctcatgtctatgccaccacttgttaggtgggagtacgactaccaacctaaggatggatctccagaggctgctctctccgagttcattaaggttagggattgggtgtga

SEQ ID NO: 232 - DNA, 732 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatccatgaagaccctcatcttgttctccaccagggatggacagaccagagagatcgcttcttacctcgcctctgagcttaaagagcttggcattcaggctgacgttgcaaacgttcacaggatcgaagaaccacagtgggagaactacgatagggtggtgattggagcctccattaggtacggacattaccactctgccttccaagagttcgtgaagaagcacgctaccaggctcaactctatgccatccgctttctactccgtgaaccttgttgctaggaagccagagaagaggactccacagactaactcctacgcccgtaagttcctcatgaactctcaatggcgtccagataggtgcgctgttattgctggtgctttgagatacccaaggtacaggtggtacgaccgtttcatgatcaagctcattatgaagatgtccggcggagagactgacaccagaaaagaagttgtgtacaccgactgggagcaggttgcaaacttcgctagagagattgctcacctcaccgataagccaaccctcaagtaa

SEQ ID NO: 233 - DNA, 840 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgccaacactatgaagaccctgatcttgttctccaccagggatggacagaccagagagattgcttcctacctcgcctctgagcttaaagagcttggaatccaggctgacgttgcaaacgttcacaggattgaggaaccacagtgggagaactacgatagggttgtgatcggagcctccattaggtacggacattaccactctgccttccaagagttcgttaagaagcacgctaccaggctcaactccatgccatctgctttctactccgtgaaccttgtggctaggaagccagagaagaggactccacagactaactcctacgcccgtaagttcctcatgaactctcaatggcgtccagataggtgcgctgttattgctggtgctcttagatacccaaggtacaggtggtacgaccgtttcatgatcaagctcatcatgaagatgtccggcggagagactgacaccagaaaagaagttgtgtacaccgactgggagcaggttgcaaacttcgctagggaaattgctcacctcaccgataagccaaccctcaagtaa

SEQ ID NO: 234 - DNA, 645 bp, Artificial Sequence
  Expression Cassette
atggttattcagtctattacccacctctccccaaacctcgctttgccatctccactttctgtgtccaccaagaactacccagttgccgtgtgctcatccatgaagaccctcatcttgttctccaccagggatggacagaccagagagattgcttcctacctcgcctctgagcttaaagagcttggaatccaggctgacgttgcaaacgttcacaggattgaggaaccacagtgggagaactacgatagggttgtgatcggagcctccattaggtacggacattaccactctgccttccaagagttcgtgaagaagcacgctaccaggctcaactctatgccatccgctttctactccgtgaaccttgttgctaggaagccagagaagaggactccacagactaactcctacgcccgtaagttcctcatgaactctcaatggcgtccagataggtgcgctgttattgctggtgctcttagatacccaaggtacaggtggtacgaccgtttcatgatcaagctcattatgaagatgtccggcggagagactgacaccagaaaagaagttgtgtacaccgactgggagcaggttgcaaacttcgctagggaaattgctcacctcaccgataagccaaccctcaagtaa

SEQ ID NO: 235 - DNA, 867 bp, Artificial Sequence
  Expression Cassette
atgcttacttcagctactactccctccagctcctctgcttcttctagagcttctaccaggttcgcctctagctcaagacctagaagaactgcttacgctaggggaagaaggcttaggccagttcttgctatggctgcttctgatgatccaagggctagatctgttgctgttgtgggagctggaatttccggacttgttgctgcttacaggctctccaagtctggtgttagggttaccgttttcgaggctgatgatagggctggcggaaagattaggaccaactccgattctggattcctctgggatgagggtgctaacaccatgaagaccctgatcttgttctccaccagggatggacagaccagagagattgcttcctacctcgcctctgagcttaaagagcttggaatccaggctgacgttgcaaacgttcacaggattgaggaaccacagtgggagaactacgatagggttgtgatcggcgcttccattaggtacggacattaccactctgccttccaagagttcgtgaagaagcacgctaccaggctcaactctatgccatccgctttctactccgtgaaccttgttgctaggaagccagagaagaggactccacagactaactcctacgcccgtaagttcctcatgaactctcaatggcgtccagataggtgcgctgttattgctggtgctcttagatacccaaggtacaggtggtacgaccgtttcatgatcaagctcatcatgaagatgtccggcggagagactgacaccagaaaagaagttgtgtacaccgactgggagcaggttgcaaacttcgctagggaaattgctcacctcaccgataagccaaccctcaagtaa

SEQ ID NO: 236 - DNA, 1590 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatccatgtctacctccccattcaacccatctgctactgcttcaggtaggccaccaaagaccttcgctgttcttggagctggaattaccggacttaccgctgctcataggcttacccaacttggacataaggtgagggtgttcgagcagtctgatagggtgggaggatctatcaagaccgaagaggttgacggatggctcattgaaggtggaccaaacacccttttgtccggtgagcttgctgtggataagctcattgatgagttgggactcaacggcgagaggattgctgctgatccagctgctaagaaccgttacattgtgagaaggggaagggctcttgctgctccaatgtctcctccatctttcttcgcctcatccctgttctctccagtggctaagttcaagcttctcgctgagcttttcgctaggcgtagggttaggactaccgatgtttctcttgccgagttcgttgagtctcacttcggaagggaattcgtggattacgcccttaacccattcgtgggtggtgtttatgctggcgatccagagaagctttctgccaggcaatctttcccaaagctctgggagattgagcagacccacggatctcttatcaggggacaaattgctgcagccaaggctagaaaggctaggggagagccaagaccaggcatcttctcattcaagcacggacttcatgtgctccctgaagctttggctgctagacttccagctggtgctattacccttggagcttcccttgatgctattgtgccaggcgataagtggaacgttgtgtggcatgatgatgtggctacccacacccagtctttcgattctgttgttgtggctttgccagctccagctcttgctaggcttcaaattggaacccttggtgagaagccactcgctgctcttgctcttattgagcaccctccagtgtccagcttgttccttggattcagaagagagcaggttgcccacccacttgatggattcggagttcttgttccagccgttgagaagagatctgtgctcggagtgctgttctccagctcacttttcccaggtagggctccacttggtcatgttgctcttaccgttatggttggaggaactaggcaaccacagcttgcatctttgcctgctgatcagttgcttgctgctgttaggccagatcttacccagcttcttggagtgtctggtgatccagttttcgtgaggcataacttctggccaagggctatcccacagtacaaccttggacacgagcacttcattgctgctttggcagctggtgagagattccacccaggacttttcatgggaggacaagctagggatggaattgctgtgcctgcttgcattgctgccggtgaaaagcttgctgagagagctggacagtag

SEQ ID NO: 237 - DNA, 1596 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgttcttccatggcttccgtgggaattatcggagctggaattgctggacttaccgctgcttacgagcttcacagaaggggacttgaggttaccgttttcgaggctaccgataggatcggaggattcattcagtccgagaggatcgatggattcctcgttgaacttggaccacagactcttcagaggacctctggtgatttcgaggaacttctcaggcaagtggatctcgaggatgcttgcattccagctagaccagttgctgccaacagattcattgtgaggggaggacagccaatcccacttcctagatctccaagagagcttctcaggaccccacttctttcaccaagagctaggcttaggcttctcgctgagccattcattcatagggctcataggtccaccgaggaatcagttgctaagttcaccagaagaaggctcggaccagaggttctcgattaccttgttgagcctttcgtggctggaatcttcgctggtgatccagagcaactttctgtgaggtacgccttcccaaagctgttcgagcttgagcaacagtacggatcccttttctggggactcatcagggataggatgaagcagagataccacccagccccaagacgttccatgttctcattcgttgagggactccacatgcttccaagggctcttgctgagagacttccagctcatgctattgtgaggaacgctgaggtgttggctattaggtgggatgagaagaacccatggacccttactttcaggcaacacggaagggcttccaccagattcttcgatattatcgtgtgcgctgtgccactccataggcttgctcaacttaggattcacccaccagtggatagaaggccactttctactgttgagcacccaccaattgctcttgtggctcttggattcaggcgtgagcaagttgcacatccacttgatggattcggaatgcttgtgccagctgttgagagggacttccagattttgggaaccctcttcagctcctcactcttcccagatagggctccagagggacatgttcttttgaccactttcgtgggaggaatgaggcatccagagcttgctttgcttccagaggataggcttgaggctcttgtgttgcaggatcttagaaggctcctcggaatttctggtgctccagttttcaggcatgtttggaggtgggagagatccattccacagtacaggcttggatacgatgctgtgcttgcttgcgttcacgacgttgagatgtctaggtccggacttttcctcgctggcaactacatggaaggcatctctgtgattgatgctctccacaccggacttaaggctgctagggctattattcagcacctcagagaagaggctgctggtggacttgctaagcttgtgcttggagattga

SEQ ID NO: 238 - DNA, 1536 bp, Artificial Sequence
  Expression Cassette
atggttattcagtctattacccacctctccccaaacctcgctttgccatctccactttctgtgtccaccaagaactacccagttgctgtgatgggcaacatctctgagagggaagaacctacctctatggcttccgtgggaattatcggagctggaattgctggacttaccgctgcttacgagcttcacagaaggggacttgaggttaccgttttcgaggctaccgataggatcggaggattcattcagtccgagaggatcgatggattcctcgttgaacttggaccacagactcttcagaggacctctggtgatttcgaggaacttctcaggcaagtggatctcgaggatgcttgcattccagctagacctgttgctgccaacagattcattgtgaggggaggacagccaatcccacttccaagatctccaagagagcttctcaggaccccacttctttcaccaagagctaggcttaggcttctcgctgagccattcattcatagggctcataggtccaccgaggaatcagttgctaagttcaccagaagaaggctcggaccagaggttctcgattaccttgttgagcctttcgtggctggaatcttcgctggtgatccagagcaattgtctgtgaggtacgccttcccaaagctgttcgagcttgagcaacagtacggatcccttttctggggactcatcagggataggatgaagcagagataccacccagccccaagacgttccatgttctcattcgttgagggactccacatgcttccaagggctcttgctgagagacttccagctcatgctattgtgaggaacgctgaggtgttggctattaggtgggatgagaagaacccatggacccttactttcaggcaacacggaagggcttccaccagattcttcgatattatcgtgtgcgctgtgccactccataggcttgctcaacttaggattcacccaccagtggatagaaggccactttctactgttgagcacccacctattgctcttgtggctcttggattcaggcgtgagcaagttgcacatccacttgatggattcggaatgcttgtgccagctgttgagagggatttccagattctcggaaccctcttcagctcctcacttttcccagatagggctccagagggacatgttcttttgaccactttcgtgggaggaatgaggcatccagagcttgctttgcttccagaggataggcttgaggctcttgtgttgcaggatcttagaaggctcctcggaatttctggtgctccagttttcaggcatgtttggaggtgggagagatccattccacagtacaggcttggatacgatgctgtgcttgcttgcgttcacgacgttgagatgtctaggtccggacttttcctcgctggcaactacatggaaggcatctctgtgattgatgctctccacaccggacttaaggctgctagggctattattcagcacctcagagaagaggctgctggtggacttgctaagcttgtgcttggagattga

SEQ ID NO: 239 - DNA, 1611 bp, Artificial Sequence
  Expression Cassette
atgactactgctgttactgctgctgtgtccttcccatctactaagaccaccagcctttccgccagatcctcctctgttatctccccagacaagatctcctacaagaaggtgcccctctactacagaaacgtgtcagctactggaaagatgggcccaatcagggctcagattgcttcctgctcatctatgatggctggctacgattctgtggtgattggaggtggaattgctggacttgctgctgcttacacccttcacaagaggggatacagggttctcgttatcgagtctactaacagggtgggcggagtgattcaaaccattactactccagagggctacatcctcgattgcggaccaaacactgttggaactggtgatgctaggctctggcaagagcttattgatctcggactcagagagaggattaccccagctgctccatgctccaagaggcgtttcattctcattaacggcaccccagttgagatcccaacttctccagtgggccttatcactaccaggcttttgtcttggaggggcaagcttagagttctcgctgagccattcatcaacaggggttctactgatccagatgagtccgtggctgctttcttcaccagaagaattggagctgaggctaccgctcaccttttggatccattcgttgctggtgtgtacgctggtgatccacagagactttctaccgctgctgttttcccatctctttgggaggctgctcaaaggtccggatctattgtgaggggaatgctctctaagccaaagcccaagacccaagtgtctgagccaaagatgaggtctaggaccttcactttcaggggtggtcttgctgaatggccaagggctcttgctcaagctcttggtgctggaaacgtttggaccgagagaagggttgtgaagttgcagccaagagactcatggtgggaggtgaccattgatggtgttaacggaccagagactctcatctcccgttccctcattattgctacccctgctttcaccgccgctgatcttattgagtctgttgatcaaagggctgctggtgctttgaggggtattccatatgctccagttgctgtggtgcacctcggattcagaagggatcagatctcccaagagttgtccggattcggagttcttgctccatcttctgagcagaggcagttccttggaattctctggacctccagcatcttcccacatgttgctccacacgatcatgtgcttaccactaccctttccggtggtgctattagaccagagcttgctgaaaggtctgacgaaacccttatcgaggctgctattagggatcaccaccagcttctcggaattaggggacagccaattttcacccatgttaccagatggcgtaccgctattgctcagtacactttcggtcacagggaaaggattgctaccttggtgcaactcgagcaaaggctcccaactattcagttcgctggatcctacagggatggtgttggagttccaaagacttgggcttctggtgttcaagctggtgagagaattgctgcagctcttgctgctcatggaaccactgctgtttctaccgaaaccgcttctggatga

SEQ ID NO: 240 - protein, 212 aa, Artificial Sequence
  Expression Cassette
MTTAVTAAVSFPSTKTTSLSARSSSVISPDKISYKKVPLYYRNVSATGKMGPIRAQIASCSSMDAPSDAFLWVKALHIIAVVCWFAALFYLPRLYVYHAMSEDDTSHRRFEVMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 241 - protein, 248 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMDAPSDAFLWVKALHIIAVVCWFAALFYLPRLYVYHAMSEDDTSHRRFEVMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 242 - protein, 361 aa, Artificial Sequence
  Expression Cassette
MTTAVTAAVSFPSTKTTSLSARSSSVISPDKISYKKVPLYYRNVSATGKMGPIRAQIASCSSMKPDAHQVKQFLLNLQDTICQQLTAVDGAEFVEDSWQREAGGGGRSRVLRNGGVFEQAGVNFSHVHGEAMPASATAHRPELAGRSFEAMGVSLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 243 - protein, 397 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMKPDAHQVKQFLLNLQDTICQQLTAVDGAEFVEDSWQREAGGGGRSRVLRNGGVFEQAGVNFSHVHGEAMPASATAHRPELAGRSFEAMGVSLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 244 - protein, 332 aa, Artificial Sequence
  Expression Cassette
MVIQSITHLSPNLALPSPLSVSTKNYPVAVCSSMKPDAHQVKQFLLNLQDTICQQLTAVDGAEFVEDSWQREAGGGGRSRVLRNGGVFEQAGVNFSHVHGEAMPASATAHRPELAGRSFEAMGVSLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 245 - protein, 243 aa, Artificial Sequence
  Expression Cassette
MTTAVTAAVSFPSTKTTSLSARSSSVISPDKISYKKVPLYYRNVSATGKMGPIRAQIASCSSMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 246 - protein, 279 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 247 - protein, 214 aa, Artificial Sequence
  Expression Cassette
MVIQSITHLSPNLALPSPLSVSTKNYPVAVCSSMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 248 - protein, 288 aa, Artificial Sequence
  Expression Cassette
MLTSATTPSSSSASSRASTRFASSSRPRRTAYARGRRLRPVLAMAASDDPRARSVAVVGAGISGLVAAYRLSKSGVRVTVFEADDRAGGKIRTNSDSGFLWDEGANTMKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 249 - protein, 529 aa, Artificial Sequence
  Expression Cassette
MTTAVTAAVSFPSTKTTSLSARSSSVISPDKISYKKVPLYYRNVSATGKMGPIRAQIASCSSMSTSPFNPSATASGRPPKTFAVLGAGITGLTAAHRLTQLGHKVRVFEQSDRVGGSIKTEEVDGWLIEGGPNTLLSGELAVDKLIDELGLNGERIAADPAAKNRYIVRRGRALAAPMSPPSFFASSLFSPVAKFKLLAELFARRRVRTTDVSLAEFVESHFGREFVDYALNPFVGGVYAGDPEKLSARQSFPKLWEIEQTHGSLIRGQIAAAKARKARGEPRPGIFSFKHGLHVLPEALAARLPAGAITLGASLDAIVPGDKWNVVWHDDVATHTQSFDSVVVALPAPALARLQIGTLGEKPLAALALIEHPPVSSLFLGFRREQVAHPLDGFGVLVPAVEKRSVLGVLFSSSLFPGRAPLGHVALTVMVGGTRQPQLASLPADQLLAAVRPDLTQLLGVSGDPVFVRHNFWPRAIPQYNLGHEHFIAALAAGERFHPGLFMGGQARDGIAVPACIAAGEKLAERAGQ

SEQ ID NO: 250 - protein, 565 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMSTSPFNPSATASGRPPKTFAVLGAGITGLTAAHRLTQLGHKVRVFEQSDRVGGSIKTEEVDGWLIEGGPNTLLSGELAVDKLIDELGLNGERIAADPAAKNRYIVRRGRALAAPMSPPSFFASSLFSPVAKFKLLAELFARRRVRTTDVSLAEFVESHFGREFVDYALNPFVGGVYAGDPEKLSARQSFPKLWEIEQTHGSLIRGQIAAAKARKARGEPRPGIFSFKHGLHVLPEALAARLPAGAITLGASLDAIVPGDKWNVVWHDDVATHTQSFDSVVVALPAPALARLQIGTLGEKPLAALALIEHPPVSSLFLGFRREQVAHPLDGFGVLVPAVEKRSVLGVLFSSSLFPGRAPLGHVALTVMVGGTRQPQLASLPADQLLAAVRPDLTQLLGVSGDPVFVRHNFWPRAIPQYNLGHEHFIAALAAGERFHPGLFMGGQARDGIAVPACIAAGEKLAERAGQ

SEQ ID NO: 251 - protein, 531 aa, Artificial Sequence
  Expression Cassette
MTTAVTAAVSFPSTKTTSLSARSSSVISPDKISYKKVPLYYRNVSATGKMGPIRAQIASCSSMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 252 - protein, 531 aa, Artificial Sequence
  Expression Cassette
MTTAVTAAVSFPSTKTTSLSARSSSVISPDKISYKKVPLYYRNVSATGKMGPIRAQIASCSSMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTVVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 253 - protein, 567 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 254 - protein, 567 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTVVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 255 - protein, 511 aa, Artificial Sequence
  Expression Cassette
MVIQSITHLSPNLALPSPLSVSTKNYPVAVMGNISEREEPTSMASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 256 - protein, 536 aa, Artificial Sequence
  Expression Cassette
MTTAVTAAVSFPSTKTTSLSARSSSVISPDKISYKKVPLYYRNVSATGKMGPIRAQIASCSSMMAGYDSVVIGGGIAGLAAAYTLHKRGYRVLVIESTNRVGGVIQTITTPEGYILDCGPNTVGTGDARLWQELIDLGLRERITPAAPCSKRRFILINGTPVEIPTSPVGLITTRLLSWRGKLRVLAEPFINRGSTDPDESVAAFFTRRIGAEATAHLLDPFVAGVYAGDPQRLSTAAVFPSLWEAAQRSGSIVRGMLSKPKPKTQVSEPKMRSRTFTFRGGLAEWPRALAQALGAGNVWTERRVVKLQPRDSWWEVTIDGVNGPETLISRSLIIATPAFTAADLIESVDQRAAGALRGIPYAPVAVVHLGFRRDQISQELSGFGVLAPSSEQRQFLGILWTSSIFPHVAPHDHVLTTTLSGGAIRPELAERSDETLIEAAIRDHHQLLGIRGQPIFTHVTRWRTAIAQYTFGHRERIATLVQLEQRLPTIQFAGSYRDGVGVPKTWASGVQAGERIAAALAAHGTTAVSTETASG

SEQ ID NO: 257 - protein, 572 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMMAGYDSVVIGGGIAGLAAAYTLHKRGYRVLVIESTNRVGGVIQTITTPEGYILDCGPNTVGTGDARLWQELIDLGLRERITPAAPCSKRRFILINGTPVEIPTSPVGLITTRLLSWRGKLRVLAEPFINRGSTDPDESVAAFFTRRIGAEATAHLLDPFVAGVYAGDPQRLSTAAVFPSLWEAAQRSGSIVRGMLSKPKPKTQVSEPKMRSRTFTFRGGLAEWPRALAQALGAGNVWTERRVVKLQPRDSWWEVTIDGVNGPETLISRSLIIATPAFTAADLIESVDQRAAGALRGIPYAPVAVVHLGFRRDQISQELSGFGVLAPSSEQRQFLGILWTSSIFPHVAPHDHVLTTTLSGGAIRPELAERSDETLIEAAIRDHHQLLGIRGQPIFTHVTRWRTAIAQYTFGHRERIATLVQLEQRLPTIQFAGSYRDGVGVPKTWASGVQAGERIAAALAAHGTTAVSTETASG

SEQ ID NO: 258 - protein, 543 aa, Artificial Sequence
  Expression Cassette
MLTSATTPSSSSASSRASTRFASSSRPRRTAYARGRRLRPVLAMAASDDPRARSVAVVGAGISGLVAAYRLSKSGVRVTVFEADDRAGGKIRTNSDSGFLWDEGANTMTESEAEVSSLIDDLGLREKQQLPISQNKMYIARDGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTIVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 259 - protein, 560 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSWKLSGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNYIGGSTNTGILSKSEGELVEAVDRDLRKMLIKPNSTDPLKLGVRVWPQAIPQFLVGHFDILDTAKSSLTSSGYEGLFLGGNYVAGVALGRCVEGAYETAIEVNNFMSRYAYK

SEQ ID NO: 260 - protein, 560 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSWKLLGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNMIGGSTNTGILSKSEGELVEAVDRDLRKMLIKPNSTDPLKLGVRVWPQAIPQFLVGHFDILDTAKSSLTSSGYEGLFLGGNYVAGVALGRCVEGAYETAIEVNNFMSRYAYK

SEQ ID NO: 261 - protein, 538 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESALEASRLIDDLGLEDRLQYPNSQHKRYTVKDGAPALIPSDPIALMKSSLLSTKSKFKLFLEPFLYDKSSTKSSKKVSDEHISESVGSFFERHFGKEVVDYLIDPFVAGTSAGDPESLSIRHAFPGLWNLEKKYGSIIVGAIMSKLTAKGDKKGSAVSGKGRNKRASFSFHGGMQTLVDALHKEVGDGNVKLGAQVLSLACICDGLSASDGWSISVDSKDASNKELTKNHSFDAVIMTAPLSNVQRMKFTKGGAPFVLDFLPKVDYLPLSLMVTAFKKEDVKRPLEGFGVLIPYKEQQKHGLKTLGTLFSSMMFPDRAPNDQHLFTTFVGGSHNRDLAGAPTSILKQLVTSDLGKLLGVEGQPTFVKHIHWRNAFPLYGHDYDSALEAIGKMESDLPGFFYAGNNKDGLAVGNVIASGSKTADLVISYLESGIKQDN

SEQ ID NO: 262 - protein, 538 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESALEASRLIDDLGLEDRLQYPNSQHKRYTVKDGAPALIPSDPIALMKSSLLSTKSKFKLFLEPFLYDKSSTKSSKKVSDEHISESVGSFFERHFGKEVVDYLIDPFVAGTSAGDPESLSIRHAFPGLWNLEKKYGSIIVGAIMSKLTAKGDKKGSAVSGKGRNKRASFSFHGGMQTLVDALHKEVGDGNVKLGAQVLSLACICDGLSASDGWSISVDSKDASNKELTKNHSFDAVIMTAPLSNVQRMKFTKGGAPFVLDFLPKVDYLPLSLMVTAFKKEDVKRPLEGFGVLIPYKEQQKHGLKTLGTLFSSMMFPDRAPNDQHLFTTIVGGSHNRDLAGAPTSILKQLVTSDLGKLLGVEGQPTFVKHIHWRNAFPLYGHDYDSALEAIGKMESDLPGFFYAGNNKDGLAVGNVIASGSKTADLVISYLESGIKQDN

SEQ ID NO: 263 - DNA, 1491 bp, Artificial Sequence
  Expression Cassette
atggttattcagtctattacccacctctccccaaacctcgctttgccatctccactttctgtgtccaccaagaactacccagttgctgtgatgggcaacatctctgagagagaggaacctacctctgctaagagggttgcagttgttggagctggtgtttctggacttgctgctgcttacaagctcaagtcccacggactttcagtgacccttttcgaggctgattctagggctggtggaaagcttaagaccgtgaagaaggatggcttcatctgggatgagggtgccaacactatgctaaaagtgttattgctctttgtgttgctgattgcggggatcgtggttggcccgatgattgccggccatcagggttatgtgctgatccagaccgacaactacaatatcgaaaccagcgtcacgggcctggcgatcatattgattctggcgatggtagtgctgtttgccattgagtggctactgcggcggatcttccgcactggcgcgcacacccgtgggtggtttgtcggacgtaagcgtcgccgtgcacgtaagcagaccgaacaggcgctgctgaaactggcggaaggcgattatcagcaagttgaaaagctgatggcgaaaaatgccgatcacgcggaacaaccggtggtgaactatctactggctgccgaagccgcgcaacaacgtggtgatgaagcacgcgccaaccaacatctggaacgcgcagcggagctggccggcaacgacaccattccggtagaaatcacccgcgtacgtctgcaactggcccgtaatgaaaaccatgctgcacgccacggcgtggataagctgctggaagttacgccacgccatccggaagtattacgtctggcggaacaggcgtatatccgcacaggtgcatggagttcgctgctggatattatcccatcaatggcgaaagcccatgttggtgatgaagaacatcgtgcaatgctggaacaacaggcatggattggcctgatggatcaggcgcgtgccgataacggtagcgaaggtttgcgtaactggtggaaaaaccaaagccggaaaacgcgtcatcaggtagcgttgcaggtggcaatggcggaacatcttattgaatgtgacgatcatgatactgcccagcaaattatcatcgatggcctgaaacgccagtacgacgatcgcctactgctgccgattcctcgactgaaaacaaacaatccggaacagctggaaaaagtgctgcgccagcaaatcaaaaacgtcggcgatcgcccgctgttgtggagcacactgggccagtcactgatgaagcacggagaatggcaggaagcatcgctcgccttccgcgcagcgctgaaacaacgtccggacgcctacgattacgcatggcttgccgacgcgctggacagactgcacaagccggaagaagctgcagctatgcgtcgcgacggtttgatgttaacgttgcagaataacccgccacagtag

SEQ ID NO: 264 - protein, 496 aa, Artificial Sequence
  Expression Cassette
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMLKVLLLFVLLIAGIVVGPMIAGHQGYVLIQTDNYNIETSVTGLAIILILAMVVLFAIEWLLRRIFRTGAHTRGWFVGRKRRRARKQTEQALLKLAEGDYQQVEKLMAKNADHAEQPVVNYLLAAEAAQQRGDEARANQHLERAAELAGNDTIPVEITRVRLQLARNENHAARHGVDKLLEVTPRHPEVLRLAEQAYIRTGAWSSLLDIIPSMAKAHVGDEEHRAMLEQQAWIGLMDQARADNGSEGLRNWWKNQSRKTRHQVALQVAMAEHLIECDDHDTAQQIIIDGLKRQYDDRLLLPIPRLKTNNPEQLEKVLRQQIKNVGDRPLLWSTLGQSLMKHGEWQEASLAFRAALKQRPDAYDYAWLADALDRLHKPEEAAAMRRDGLMLTLQNNPPQ

SEQ ID NO: 265 - protein, 534 aa, Amaranthus; identical to SEQ ID NO: 1

SEQ ID NO: 266 - protein, 461 aa, Salinibacter; identical to SEQ ID NO: 53

SEQ ID NO: 267 - protein, 469 aa, Rhodothermus; identical to SEQ ID NO: 51

SEQ ID NO: 268 - protein, 461 aa, Salinibacter; identical to SEQ ID NO: 52

SEQ ID NO: 269 - protein, 469 aa, Rhodothermus; identical to SEQ ID NO: 55

SEQ ID NO: 270 - protein, 472 aa, Halothiobacillus; identical to SEQ ID NO: 64

SEQ ID NO: 271 - protein, 441 aa, Coralibacter; identical to SEQ ID NO: 68

SEQ ID NO: 272 - protein, 463 aa, Magnetococcus
MTKNPILIIGGGISGLSTAWFLHKKGEKVILLESRDRVGGNIRTSRNPEGYLIEHGPNSTLQKPGDEEDALGRIITDMALESELQEANPLAARRFVMKGGQLHVLPTSPPGFIKTPLFSLSAKLRLCLEPFIGKSEQEESIAQFVIRRLGQEFLDYAIEPFVSGVYAGDPKQLSVRAAVAKIYALEAKYGSLIKGAIALGKIRKAAGMPRGRMISFETGMETLPATIANRLPHQSIHTNAQVTALCQHGAAWQVSWQQGGQHGGEPHSIIASQVVLATPASVSAQLLRPLSPQAADLLESIRYAPVDSVALGYAKQDINHSLDGFGFLIPRKEQVTTLGGLFSTTLFPGRAPQDKALLTCFIGGMTNPSITQWSEEKVVTQVDQDMMAALGIQHGAEYVHLTRYTHAIAQYEQGHLQRVGDIDRALAGYKGLHLRANWRDGVSVSDCVLNGEKSAQKILAGVS

SEQ ID NO: 273 - protein, 467 aa, Opitutus; identical to SEQ ID NO: 57

SEQ ID NO: 274 - protein, 451 aa, Melioribacter; identical to SEQ ID NO: 63

SEQ ID NO: 275 - protein, 501 aa, Physcomitrella
VAVVGAGVSGLAAAHRLRSAGVAVTVFEAQNAVGGKIQSFSNDGLIWEQGPNTMVETEPEVSSLIDELGLREKQQWPVMQNKRYVVRDGKAVQLPSNPLGLITTKLLSAQAKCQILLEPFLWKRKEVPLKEAANGRENVGNFITRHFGREVVDYLVDPFIAGTSGSDPDSVSIRHTFPDLFAIEERYGSLLIGGVKSSFKKKSGSKKESFKVQSDSAKVTPAQKRPRGSFSFVGGMQTLAHALSERLDEESLELNSSVLNLASDQQGNPSRNNWTVTYKKENSQQKEKHFDAVILTTPLHNLQELGIEKNGIPYALDFIPEIVYQPMSVIVTAFKESDVKNSLKGFGVLVPRMEKKNGFFTLGTMFSSSMFPDRAPPGQVVFTTFVGGSRNRALASAPFEEVKAVALEDLRKIVGVQGPPVAVKHIFWKQAFPQYSLDYNEFLSSLEKMESDLPGLFYAGNHRGGLSVGKSVASGCKAAEHVLSMLEGTGGRKIFTMASTK

SEQ ID NO: 276 - protein, 511 aa, Ricinus <angiosperm>; identical to SEQ ID NO: 9

SEQ ID NO: 277 - protein, 476 aa, Chromohalobacter
MQHEEQLDATDQAVGEARRDVVVVGGGASGLAAARAAARRGLAVSVLERGSHAGGNLRTHRDGAWQVEVGPNTLVMKPPLHTLLDELGLLDEAQPANPDARRRYIAFHGRPVALPTHVLKAPANPLIGLRGSWSVLREPFRAGPPRDEESLADFVVRRLGRHVLDHLVDPFVSGVYAGDPARLSAQAAMPRLVALEREYGSLVRGGLRRLRQSRREPPALPREWRGQLVSFPAGLQRLAERLAEDIADQPGASVQCGCEVVAVGREADGWQVETAAGQRIRTRELVLAVPAPTAAALLAPLDAALAAPLEEIAYPPVNAVSVGFRRADVDHPLDGFGMLIPGVERRRTLGALFSSTLFPGRAPSDHVLLTAFLGGRRQPEAAAGDDAEQVAQVVADLGDLLGIHAEPVWQCVSRWPQAIPQYERGHLARIAALDAALEAHPGLSLLGNWRDGIAVGDCLENGRRLGERLAETPDRR

SEQ ID NO: 278 - protein, 462 aa, Leptospirillum; identical to SEQ ID NO: 75

SEQ ID NO: 279 - protein, 514 aa, Selaginella; identical to SEQ ID NO: 44

SEQ ID NO: 280 - protein, 520 aa, Selaginella; identical to SEQ ID NO: 43

SEQ ID NO: 281 - protein, 508 aa, Arabidopsis; identical to SEQ ID NO: 22

SEQ ID NO: 282 - protein, 454 aa, Acidithiobacillus
MSSETVIVVGAGLTGLSATWYLHQRGIPALLLEAEAEVGGNLRSRSEDGFLRDLGPNSLMIKGDLLPDLIRQLQLEDRVVEANPLARRRFVLNRRGHPVALGPDVLFSSSLLSLSARLRLLSEPWRPRRPQSQNDESIADFVRRRLGPEALTWMVDPFVSGVFAGDPEKLSVTAALPRLAAMEAESGSLLRAALRRRRAGKKEGSSRLVSFRGGLQELPRALAARLPPDRLALSRPLTHLQRRGELWHLQTPAGDLECRRLVLALPAAESARLLRAEAPELAAELEAIVYPAVATVALGFPREAVDHRLDGFGLLIPRRLGIETLGVLFSSTLFPERAPPGMVLLTAFLGGAQQDISGRSPAELEAQALADLRPILGIRGDPAYHRCALWPRAIPQYALGHRQRVERIHELRRQLAGLELLGNWQGGVALGDCVVQADAFQRTFAQVDTATGPS

SEQ ID NO: 283 - protein, 512 aa, Arabidopsis; identical to SEQ ID NO: 23

SEQ ID NO: 284 - protein, 502 aa, Glycine; identical to SEQ ID NO: 11

SEQ ID NO: 285 - protein, 474 aa, Chloroflexus; identical to SEQ ID NO: 73

SEQ ID NO: 286 - protein, 499 aa, Medicago; identical to SEQ ID NO: 13

SEQ ID NO: 287 - protein, 475 aa, Chloroflexus; identical to SEQ ID NO: 77

SEQ ID NO: 288 - protein, 508 aa, Vitis; identical to SEQ ID NO: 8

SEQ ID NO: 289 - protein, 544 aa, Zea; identical to SEQ ID NO: 31

SEQ ID NO: 290 - protein, 478 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMKKSSKVSDASAEESVSEFFQRHFGQEVVDYLIDPFVGGTSAADPDSLSMKHSFPDLWNVEKSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAVIMTAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 291 - protein, 441 aa, Hydrogenobacter
MIDVAVVGAGISGLSIAYHLKKAGLEVKVFEKEDAVGGNIQTAYIDGYVCELGPQTILADSKVEEFLKDAGIKPIYANPSSKKRYIYRKGKLVALPLSPVEFLLSPFLSLGGKLRVLKEPFVPRSPKQEESIAEFVRRRFGREFLDYVVAPFVSGVYAGDPEELSVKYAVRKVYELEQKYGSVIKGAIKLKALGPSGKLISFEGGNATLIRKLSESLEVHKENVVLRIRRKDDIFILDTKEGKVTAKAVVVSTPATSTGYLLRDLSWSISEEFDKIYYAPVLVVHVAVKFGVLPEGFGFLVPKKENKRILGVIFSSNLFEGRSPEGKSLITVYIGGATDPEIIEYEDEAIVSVLERELRETVDIRDWDLLKITRWKKGIPQYTVGYGRYLELANSIEMEQPGLFLSGNYLYGVSVADCIRVSHHIAKRVIDFLEVKGRTVV

SEQ ID NO: 292 - protein, 458 aa, Thermovibrio; identical to SEQ ID NO: 97

SEQ ID NO: 293 - protein, 462 aa, Ignavibacterium; identical to SEQ ID NO: 59

SEQ ID NO: 294 - protein, 544 aa, Sorghum <genus>; identical to SEQ ID NO: 28

SEQ ID NO: 295 - protein, 456 aa, Desulfurobacterium; identical to SEQ ID NO: 78

SEQ ID NO: 296 - protein, 446 aa, Acidithiobacillus; identical to SEQ ID NO: 95

SEQ ID NO: 297 - protein, 433 aa, Thermocrinis
MMDVIVVGAGISGLSVAFRLSKEGLKVKVLEKEEEPGGNIRTRKVGDFLCELGPQTVLADGEVVDFFREVGIQPQEASPSSSVRYIYKRGKLIPLPNSPVKFLTSPLLSLGGKLRVLMEPFVAPSVKTEETVAQFVRRRLGEEFLHYVITPFVRGVYAGDPEELSIKYAFRRVYQLEREYGSLIRAAIKLKRLGPPGKIISFEGGNQSIIQQLASYVDLETENVALRIRRKDDRYILDTKEGKYEARCVVVASPATSAGYLLRDISWSAAQELDKIYYAPVVVVHVATSQNIPDGFGFLAPQKEDLRILGVLFSSRIFPNKAPQGKELLTIYMGGATDPEVVEYEDELIMRIVEEDLRKSLGLTQLEFLLVTRWKRAIPQYTLGYGRYIELVEALQRENPGLFITGNYLEGVSVADCIKRSKRVVQEVVKFFR

SEQ ID NO: 298 - protein, 440 aa, Laribacter
MVVVIGAGISGLSCAWHLQQRGIPVVVLEAGSRVGGKIGTVAADGYRLELGPNTLYGHAGHLDLLERLGLTAAIRPAAAVVRHRFVLRGDRYEALPSGPLSFLTGSQFGARSKWLALTEPFRRNRPVREPETVAAFFRRRLGDEFVERAISPFVGGIFAGDPEELVAGLTLPVIHEAERQSGSIVRGMFARRKTFRRKATFTLNEGLQQLPETLAQGLDVRLDTSVQALERLETGWRVRTPAGELDADEVVLAVPADVAGQLLASHFPAIAANLANVTYAPVAVLHTAWPRSTVGHDLDGFGGLNPKVEKPFAAGSIWSGSLFPDRTPAGETLLTTFVGGMQFLDRYRHDDATLVALALEELRRLYRIQGEPTLCRLTRQEQAIPQYDSHALPLASAVSDLHEHGIRVCANWHGGVSVVDCLDKGQQVAVQCLLDYPPAS

SEQ ID NO: 299 - protein, 446 aa, Acidithiobacillus
MEEVIIIGGGISGLATAYFLRKRGWSPLLLEAGAAPGGNLQSRQEEGYLRDMGPNSLMLKGRIVPEWLRELQLEGDIVEANPLAGRRYVLNRHRQPVALGPGVLFGGGLLSIRGRLRLLGEPFQPPHPTPDGEESIADFVRRRLGDEALTWLVDPFVSGVFAGNPARLSVQATLPRLAALEQDGGSLLRGALRARKKKLPGTPKTRLVSFREGLQVLPLRVANTLGDTLRCDTPVDQLAYSGDMWQVGSGNQTWQSKRLVLALPAGAAARLLAQTDATLARELDAIPYPAVGSLSIGFRRPQVEHPLDGFGMLIPRVMGLETLGVLFSSTLFPGRAPAGQVLLTAFIGGSQNVLAGRDDDDLLATVLREIGPLLGISGDPVFSRCRVWPKAIPQYEIGHLDRMKRIDTLSAGHPGLHFRANWQGGVALGDCIEQAWEFSQTADWQH

SEQ ID NO: 300 - protein, 453 aa, Deferribacter
MKIAIIGGGISGISTAFWLEYFAKERLKSIDITIFEKNKRLGGTINTFYKDNFIIESGPNGFLDSKPYTVETFEKAGLGDNLIRSNELAKKRYIMRGGVLHKLPEKPNEFFSSKLLSFKGKLRVISELFIPAKKDEYDETIEEFAYRRLGKEAADYLISPMVSGVFAGDPSKLSLKSCFPVIYNLEKEYGGLFKAMFKKKGKKSGPAGPGGNLTSYKGGLIKGINALTEQLSNTKIYLGEEVTGLDKTNGSFKVKTTNSCDNYDIVIITSPAYVAAEFIKGLSVELSDKLLKLNYAPMYVIGFGFKEEDVLDPLDGFGFLVPHNENRKILGALFTSSIFPERAPKGYKLIRVMIGGDKNRWVLNCSEDELRDIAFNEIKDILGVKGNSVVEKSFYWERAIPQYYQGHEKLVEDIESICMDINNIYIGGNLLYGIGINDCTKRSIDIARGVLGG

SEQ ID NO: 301 - protein, 471 aa, Geobacter; identical to SEQ ID NO: 94

SEQ ID NO: 302 - protein, 450 aa, Thermodesulfovibrio
MGSAEIVIVGGGISGLSLAYFLIQKNSQLNIKIVEAEKRAGGKIITENISGFLCEGGVNGFLSNKPSTISLAKELNIEPLRGSESSKIRYILIDGKLIRVPENPIKFFLTPLLSFSGKIRMLREYFTPPLKEEIDETVESFVSRRVGKEFYEKLIDAMSTGIYAGDPSKMSMKSCFPKVYWLEKRHGGLLKGLIALKKEKKDTKAQPSGVLMSFKGGMSELIQSLERHLSSRILKGKKVLSIDRKNTYYTVHLDDGNFIEAEKVILACPAHESAEILKELSSELSDILKTIPYPPLSVVAFGFKKEQIGFGTSLYGFLIPYREQRKILGTLFDSSIFPNRAPESYVLLRSMIGGRRAPELAMLPDEKLIDTALSELKPLLNIKGDPEFIKIFRWEKAIPQYELGHEDKLNRIEQILSEFSGLYLTGNAYRGVSVNDCIENSLKLAEGIMV

SEQ ID NO: 303 - protein, 469 aa, Geobacter
MKKAIVAGGGISGLATAYLLKTRAAEEGLELDVTLVEREERLGGKIWSIKEEGYLCEWGPNGFLDSKPQTLDLCRELGASDLLLRSNDNARKRFIYTGGALNRLPENGPMFLKSGLISWPGKLRLAMEPFIPKKAGDEDETLAAFGRRRLGDEALRKLIAPMVSGIFAGNPETMSLRSCFPRIAELEDEYGSLVRAMIRLAKKKKQEVAQGKAVASAAGPGGVLTSFRDGIQALTDILAERLGPDTIVSGQEVLEVSRGGSLPWRVRTGSIDMDADLVILATPAYATASIIQGVDSDMAGILRQIPYATMTVVCFGYDRERIAHDLNGFGYLIPKEEGMNTLGTLWDSSIFENRAPEGQVLLRSMMGGACFPEYVNLTDEEVTGRVKNDLATIMGITAPPSFVRIFRHHQAIPQYTVGHSTRVAALEQRAASLPGLFLTGNSYRGIGLNDCVAAANRTAGEAIAQLTSR

SEQ ID NO: 304 - protein, 469 aa, Geobacter
MKKAIVAGGGISGLATAYLLKTRAAEEGLELDVTLVEREERLGGKIWSIKEEGYLCEWGPNGFLDSKPQTLDLCRELGASDLLLRSNDNARKRFIYTGGALNRLPENGPMFLKSGLISWPGKLRLAMEPFIPKKAGDEDETLAAFGRRRLGDEALRKLIAPMVSGIFAGNPETMSLRSCFPRIAELEDEYGSLVRAMIRLAKKKKQEVAQGKAVASAAGPGGVLTSFRDGIQALTDILAERLGPDTIVSGQEVLEVSRGGSLPWRVRTGSIDMDADLVILATPAYATASIIQGVDSDMAGILRQIPYATMTVVCFGYDRERIAHDLNGFGYLIPKEEGMNTLGTLWDSSIFENRAPEGQVLLRSMMGGACFPEYVNLTDEEVTGRVKNDLATIMGITAPPSFVRIFRHHQAIPQYTVGHSTRVAALEQRAASLPGLFLTGNSYRGIGLNDCVAAANRTAGEAIAQVTSR

SEQ ID NO: 305 - protein, 436 aa, Aquifex
MDMREVVVIGAGISGLSTAYRLKKEGVDVVVYEKDDRIGGTIHTVKEKGYLFEVGAQTILADQEVIDFLKEAGIEPVEASPSSKYRYIYKKGRLIPLPMSPVEFLKTPLLSLKTKLKVLTEIFKRGVDEDISIADFVREHFGEEFLNYVVAPFISGVYAGDPEKLSLKHATPKLYEAQKKYGSLIKAFIKEKTAGPKGKLISFGEGLGELINALAQKLEVHTENVVLRMRKFEDFFRLDVRGKKVETKSVVVASPAYTSSYLLKEVSFSASEEFDKIDYPPVVVVNVGVEGKFPKVRLLSSESGKKRILGAMFMSKLFPGRAPQGKELLTVFLGGATDREVIELSEEEIENIVERELKEILQIDCIDFMHVQKWKRAIPQYTLGYDRFLNLAQEMEKDYPGLFLTGNWLYGVSTADCIRASKKVAQKVLSFLRPQA

SEQ ID NO: 306 - protein, 470 aa, Pelobacter
MNISVVGAGISGLATAFAIQQQARRLGLEWTLDIFEKEDCSGGKIRSEKVDGYLCEWGPNGFLDSKPMTLDLCREAGLAEQLLRSNDAARKRFIFSGGRLQRVPESAADFFRSSLVSWPGKLRLAAELLVPRRKDLTDETLADFVRRRLGREALDQMVGPMAAGIFAGDPETMSLRSCFPRIHELEQQYGGLIRALLLLARKKRAERRAGKAVAGAAGPGGILTSFGGGIQELTDGLSRLLAPNLHLGDAVAAITPLKEGFSLRTHKGRVHETDIVVAAVPAMALATQVEGFSAPMAAQLRQIPYAPLQIACFGYRREALPLSLDGFGYLAARRSGMHSLGTLWSSSIFPGRAPAGYVLLRTMFGGATRPDAAQLSADEVQQRVEEDLSRSMGIKQAPDFVRIIRHTAAIPQYVSGHGARLKVLEDKAAAYPGLFLVGNAFYGVGLNDCVAAADRVASRVLTLMQQRQQA

SEQ ID NO: 307 - protein, 469 aa, Geobacter; identical to SEQ ID NO: 90

SEQ ID NO: 308 - protein, 435 aa, Cytophaga
MIAIIGAGISGLTLAYQLQQAGKPYILFESNSRPGGYINSQRFGKYLLEVGPNSILVDKKLEEFIHELNLDKLFEPAAIINKNRFIYKDANIQQVPSGPLSFLTGRFFSAKTKYAIFKELFNKSISKENETVYDFFARRFSAPFTQYTIDPFATGVYAGDIKQLLIEETFPQLVELEKQYGSIIKGIFKKGFGEKRKTGTFVHGLQTLTDTLAAQLHSLQLNTRVLNLRKQMDKIVLTTDTKHGIEELTFDKVVVCGTTFQAATLIKDSYPDLSAILSQVQYASMKAVFAAFKRTDVTHPMNGFGCLYPSAEQSFLAGTIWNSSIFNDRCPADEVLTTSFIGGMHHPEYTALSESELEQRAIQQLSKDLGITGKPTFTHVAGWNKAIPQYDIYLKKARLASKLLSDDHIYFRSNWTNGISLGNCIQSARDLALIL

SEQ ID NO: 309 - protein, 471 aa, Geobacter
MKKAIIVGGGITGLATAWLLREKAKKAGMELEIALLEKEERVGGKIRSIKADGYLCEWGPNGFLDNKPQTLDLCRDLQADSQLLRSNDNARKRFIYSEGFLHQLPENGPSFFKSKLISWPGKLRLALEPTPFIAKAPDGVDETLAAFGRRRLGDEALRKLIAPMVSGIFAGDPETMSLQSCFPRIAELEREYGGLVMAMVKLAKKKKQELAEGKAVASAAGPGGILTSFRDGLQTLTEIIRGQLGCEVLSVGEEVVRIRKGSSVPYRVETTSRELDADVVVLATPAYATGQMLEGLDSAMTGILGQIPYATMSVVCLGYEQDKISHDLNGFGYLIPKGEGMNILGTLWDSSIFENRAPQGRVLLRSMMGGACFPEYIKLSDEEVQRRVCDNLKTIMGIAAPPDFVRIFRHEKAIPQYTVGHGKRLQALLDAGRNHQGLLLTGNSYRGIGLNDCVAAAVRSSNEVMEHLQKR

SEQ ID NO: 310 - protein, 465 aa, Porphyromonas
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVATPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDHFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLRIPHTCKPDLLHISRHRHAIPQYYADTELRQDIIRRMEMRWPGLHLGGNMHGGIGMAHRISQGVEMARSIIEETAIAERSARG

SEQ ID NO: 311 - protein, 464 aa, Corallococcus
MTVAVIGGGITGLALAYQLRARGTDAVVLESTSRVGGNVQTHARGGYLLEAGPNSFLDREPTTRELADALGVSSRIRPADVAAKNRYVFTRGALRALPTSPPAFLKSDILPLASRLRVVGELFSGRNPTGADESLAQLGRRHLGREATAVLLDAMQTGTYAGDPEQLSAEATFPQLVKFEREHRSLILGAIRAQRAARQAKGAVETGPRLTGQMSTFDGGLGVLVDALAKALGDSVRTDAKVEGLERAADGWTVRYQQRGQPAELSASHVVLAVPAHVAASLVRPLDAELAQKADAIPYAPIAVVHLGFAPGTVPKPDGFGFLVPAVEGTAMLGTIHVSTTFPFRVEGGRVLLTCLMGGARRPEVVSRDEDALVALAREELKAMAGLTATPELTAVFRWPRGIPQYTVGHLERLAAMEERLKRWPGLHLAGNAYRGVGVNDCLKEAARLAEALGGPAAGATRSA

SEQ ID NO: 312 - protein, 454 aa, Calditerrivibrio
MRVAIIGGGISGISTAFLLENLKNELNLDMEITIIEKRLRWGGSIETSREDGFIVEAGPNGFLDSKPHTLELLSMAGLSNNLVKSNDLARKRYIMRNGILHRLPENPPMFFKTKLLSFSAKMRILSEYFIQKSVLEDESVADFARRRLGKEALEYLISPMVSGIFAGDPEKMSLRSCFPVIRDLEINYGGLFKGMIKKKGKKSGPSGPGGILTSYKNGLDNMITDLLESTSITKMLNTEVFSIDKKINRYILNTNKGIMEFDKIFINAPAYAVSQMLSVLDKDLSRDLNNITYPPVFVAGFIFKPEDLEDPLDGFGYLIPHSENKRILGALFDSSIFPDRTRDGYKIVRTIMGGDKNRWIIEKSDDELIRMAFDDIKETLKIKREPYKIKYFRWEKAIPQYYIGHHKIVEKVEEFYKKFDDIFIGGNILYGVGINDCTRTSFMNVDRFKNLLNK

SEQ ID NO: 313 - protein, 465 aa, Porphyromonas
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVGTPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDHFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 314 - protein, 454 aa, Stigmatella
MAVIAVVGGGITGLALAHRLRSRGKDAVVLEAGAHLGGVIQTRQRDGFSTETGPNSFLDREPATRELAASLGIEERIRMADPSAKSRSLYTRGQLRPVPASPPAFLKSDLLPLGTRLRVLAELFTGRAPPGQDESLGDFGRRHVGARATSVLLDAMQTGTYAGDVEALSAEAAFPTLKQLEREHRSLLLGAVRTQGRQRAPAPAGTKLKGAMCTFEGGLGTLVEALARALGPAARTGAAVEGLARSQNGWRLSVRERGQQAELEASQVVLTSPAHVSAELLAPLDPSLAGHLKGIPYAPIAVVHLGFAPGKTPPPDGFGFLVPGQEQRQLLGVIHVSTVFPFRAEGGRVLYTCLMGGARRPDLVGLNEEALAALAQQELREMAGVTASPDFTEAVRWPRGIPQYTVGHLERLSAIDSALARLPGLHLAGNAYKGVGLNDCIRNAAALAETLASR

SEQ ID NO: 315 - protein, 465 aa, Porphyromonas
MDHLTVIIGAGLTGLTTAAFLRAAGRPVLVLERAAHIGGQIRTYRENGFVFETGPNTGTISSPEVAELFELLGLEPEIATPAASNRLIWKGNKLYPLPRNIAEAVATPLFSLWDKWRILGEPFRRRGGQPNETVGALARRRLGKSFVDYAVDPFLGGIYAGDADQLVTRFALPKLYDLEQRYGSFVLGAVRKARQPQNERDRKASRKVFSVQGGLGLLVEALADYIGREHILTETQIRYINHPGAHTFGLTYTDASEEEHTIPCRHLVSTVAAHHIPTLFDRFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 316 - protein, 462 aa, Leptospirillum
MSTVFRCDVLIVGGGISGLAAAMVLHQAGKNILLVESRGYLGGAIRSVEDSGYLLEMGPNSMMLGPEDPINVWLDKLGLSEKLLKASPEAQNRYVWCQGKLIPVPLSPSSFLTTPLFSLSEKMRVAKEFFISPGSGLPEGSDETVGHFVRRRLGNEFLEKLIDPFVKGVYASHPDLLSLNSAFPLLARLEQESGGLIRGAIRLSREKKRKKANLTGPPGGLYSFSGGLGEMVRAFSGYLKDESLIHGELIHWNRLPSGEFQCVLLQDEERVEVISQKMILATSPADAGRILEKNQPEIASVLSSIPMAPIAIAYIGVDRKALPGYLPGFGVLFPTSEKRKILGIIQNSDLFPNRSPDGKVLLTIFAGGMLSPKIAMSFDEDFEQIVLGELKTVFGLDSRPEFFRIQRWAEGISQYSPGHASRIQRIRDLTPEGMILTGNYLGGISVLKTFTNGLEAGKAFLS

SEQ ID NO: 317 - protein, 454 aa, Spirosoma
MTIGIIGAGISGLTLAYELQRRGIAYHLWEAAGQAGGYIRSQRDWPDGPSGRNYLRELGPNSLLGDAELLNWLDELGLTPELTFSQPVSKARFIFRDGKYRQLPSGPPSLLFGNFFSWKTKLAILRERNNKTVSPPGETLGQFFRRRFSSEIVDYALGPFVAGIYAGDPEQLLVSETFPSLLQYEKEYGSVLRGLIKSQSAGGSAIGRRQSFSFREGMQMLPNALAAKLTNLSLNEAVSSISPTPNGWEVETNTGTTTVDKLVLAVGTDAAARLVDQRYPDLARTLQAITYPPMTAVHSAYKRADVRHPLNGFGGLNPAVEGRFAAGHIWSSSIFTGRCPDDEVLFTTFVGGQTGAHNTRHPDSVLAHNVHKELVDGFGITAATPVYQSVFRWERAIPQYDATLASAKESVKAMEADQLFVCANWYGGVSLSDCIGKSRKLADQLAVKPFIKNF

SEQ ID NO: 318 - protein, 495 aa, Candidatus
MATEQHSGSRRIVVVGSGIAGLAAAYRLQERCEQDGPPCEVRVLEAAARPGGAISTTHRDGFVLESGPDTIFTDKPWGLDLIRRLGLSEQVIGTNEAHRRTFVVRDGALHPLPEGFALMGPTKPWPFLQSGLLSWRGKARAALDLVLPRGGPSDDESLASFVRRRFGQEFLDRLAQPMIGGIYGADPERLSLRATFPQFLQMEATHRSVILGLRRMRPAGRGVGHTSSGPRYGLFVTLDHGLQALVDAMVKRLPAGTLRLRAPVDRIAHTEQGWTVRLGDGASLQADGLILAVPAFEIARLTHDLDQDLARQLEAMPYASSVTINLAYRREAIHHPLDGFGFVVPACEGRTIIACSFSSVKFAHRAPAGHVLLRAFAGGALQPEPFTWDDETLLSAVRRDLEELLAIHAPPLWSQLVRHPRVMPQYQVGHLGRLAALEETLRRWPTLKLTGNAYRGVGVPDVVHSGETAADSLLAELAPSPTEPTPACTEGDSRL

SEQ ID NO: 319 - protein, 469 aa, Pelobacter
MKRAIIVGGGISGLATAWLLREKALACGIQLELVLLEKDQRPGGKIRSIHEGGYVCEWGPNGFLDSKPQTLELCDAVGVSSDLLRSNDNARKRFIYSDGELHRLPEGGGTFLKSRLISWPGKLRLALEPTPFIARTPAGVDESLADFARRRLGGEALDKLISPMVSGIFAGDPETMSLVSCFPRIAQLEREYGGLIRAMVRLARQKKRERAAGKAVSSAAGPGGVLTSFRPGIQYLTDSLAASLGGIVMADREVSWVRRGKSAAWRVGCRDGGEYDADLVIVASPAHAASAILHDCDAGIASILESIPYASMTVVCLGYERELVSHPLDGFGYLIPKKEGRSILGTLWDSSMFENRAPTGKVLLRSMVGGACFPDYVHMGDDELLGRVRGDMKDVMGIVAEPSFIRIFRHPQAIPQYTVGHGERLKHLEERLACHPGLILTGNSYRGIGLNDCVAAAQRASDQALELLR

SEQ ID NO: 320 - protein, 436 aa, Aquifex; identical to SEQ ID NO: 305

SEQ ID NO: 321 - protein, 495 aa, Candidatus; identical to SEQ ID NO: 318

SEQ ID NO: 322 - protein, 457 aa, Unknown; identical to SEQ ID NO: 67
  Unknown

SEQ ID NO: 323 - protein, 462 aa, Unknown; identical to SEQ ID NO: 74
  Unknown

SEQ ID NO: 324 - protein, 467 aa, Unknown; identical to SEQ ID NO: 26
  Unknown

SEQ ID NO: 325 - protein, 535 aa, Amaranthus; identical to SEQ ID NO: 5

SEQ ID NO: 326 - protein, 493 aa, Silene
TSDPDKLQSSAKRVAVIGAGVSGLAAAYKLKSNGLNVTLIEADERAGGKIRSAAKNGYIWDEGANTMTESESEVTSLLDDLGIRDKQQLPLSQNKRYVVRDGLPVLLPSGPISIFTSNFLSPKSKLRLLCEPFSWRRRDNAKVSDEQADESVSDFFGRHFGEEFVDYLIDPFVGGTSAADPKTISMRHSFPELWDIEDRFGSIIAGAIQSRLTPKPGEQKKPVKKTRVRGSFSFKGGMQTLVDTICERFSEDELKLKCKVLSLSYSHEGHSNNWSLSCLSNKSIEDRPYDAVVVTAPLTNVKDMKILNGGSPFSLDFVPEVDYLPVSIIVTAFKKANVERPLEGFGVLIPSKEQEKGLKTLGTLFSSMMFPDRSPADQYLYTTFVGGSRNRELARATTDELKQVVLSDLQQLLGVKGDPSFINHVYWSKAFPRYGQNYESVKMAIAKMENDLPGFFYAGNHKDGLSVGKALASGYKAADLVMSYLNSYSNTNQ

SEQ ID NO: 327 - protein, 493 aa, Silene
TSDPDKLQSSAKRVAVIGAGVSGLAAAYKLKSNGLNVTLIEADERAGGKIRSAAKNGYIWDEGANTMTESESEVTSLLDDLGIRDKQQLPLSQNKRYVVRDGLPVLLPSGPISIFTSNFLSAKSKLRLLCEPFSWRRRDNAKVSDEQADESVSDFFGRHFGEEFVDYLIDPFVGGTSAADPKTISMRHSFPELWDIEDRFGSIIAGAIQSRLTPKPGEQKKPVKKTRVCGSFSFKGGMQTLVDTICERFSEDELKLKCKVLSLSYSHEGHSNNWSLSCLSNKSIEDRPYDAVVVTAPLTNVKDMKILNGGSPFSLDFVPEVDYLPVSIIVTAFKKANVERPLEGFGVLIPSKEQEKGLKTLGTLFSSMMFPDRSPADQYLYTTFIGGSRNRELARATTDELKQVVLSDLQQLLGVKGDPSFINHVYWSKAFPRYGQNYESVKMAIAKMENDLPGFFYAGNHKDGLSVGKALASGYKAADLVMSYLNSYSNTNQ

SEQ ID NO: 328 - protein, 501 aa, Solanum; identical to SEQ ID NO: 21

SEQ ID NO: 329 - protein, 463 aa, Unknown; identical to SEQ ID NO: 87
  Unknown

SEQ ID NO: 330 - protein, 544 aa, Zea; identical to SEQ ID NO: 30

SEQ ID NO: 331 - protein, 507 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGVLIPYKEQQKHGLKTLGTLFSSMMFPDRAPNDQYLYTSFIGGSHNRDLAGAPTAVLKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 332 - protein, 542 aa, Setaria <grass>; identical to SEQ ID NO: 27

SEQ ID NO: 333 - protein, 507 aa, Brachypodium
MAASDDPRAAPARSVAVVGAGVSGLVAAHRLRKSGVRVTVFEADDRAGGKIRTNSDSGFLWDEGANTMTESALEASRLIDDLGLQDKQQYPNSQHKRYTVKDGAPTLIPSDPIALMKSTVLSTKSKFKLFLEPFLYEKSHTRNSQKVSDNHLSESVGSFFERHFGKEVVDYLIDPFVAGTSAGDPESLSIRHAFPGLWDLEKKYGSIIVGAILSKLTAKGDSTKKADTSSGKGRNKQASFSFHGGMQTLVEGLHKDVGDGNVKLGTQVLSLACSCDRLSASDGWSISVNSKDASSKLAAKNQLFDAVIMTAPLSNVQRMKFTKGGVPFVLDFLPKVDYLPLSLMVTAFRKEDVKRPLEGFGVLIPYKEQQKYGLKTLGTLFSSMMFPDRAPNDQHLFTTFVGGSHNRDLAAAPTAILKQLVTSDLRKLLGVEGQPTFVKHVHWKNAFPLYGHDYDLALEAIGKMENELPGFFYAGNNKDGLAVGNVIASGSKTADLVISYLESHQAR

SEQ ID NO: 334 - protein, 551 aa, Oryza
MLSPAATTTTTTSYCSYSSRAHAPTRSASAGAARFRPARAMATSDNDPRGAAPARSVAVVGAGVSGLAAAYKLRKRGVQVTVFEAADRAGGKIRTNSESGFIWDEGANTMTESESEAGRLIDDLDLQGKLQYPNSQHKRYIVKDGAPTLIPSDPIGLMKSTVLSTKSKLKLFLEPFLYEKSSKRNSGKVSDEHLSESVASFFERHFGKEVVDYLIDPFVAGTSGGDPESLSIRHAFPALWNLENKYGSVIAGAILSKLSTKGESVKTGGATPGKGRNKRVSFSFHGGMQSLIDALHNEVGDGNVKLGTEVLSLACSCDEISSSGGWSIAVDSRDAKGKDLRKNQSFDAVIMTAPLSNVQRMKFTKNGAPFVLDFLPKVDYLPLSLMVTAFKKEDVKRPLEGFGVLIPYKEQQKHGLKTLGTLFSSMMFPNRAPNDQYLYTSFIGGSHNRDLAGASTAILKQLVTSDLRKLLGIEGQPTFVKHVHWGNAFPLYGRNYDLVLEAIAKMEKNLPGFFYAGNNKDGLAVGNVIASGSKAAELVLSYLESHTDQDN

SEQ ID NO: 335 - protein, 494 aa, Picris; identical to SEQ ID NO: 38

SEQ ID NO: 336 - protein, 506 aa, Oryza; identical to SEQ ID NO: 37

SEQ ID NO: 337 - protein, 465 aa, Unknown
  Unknown
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVGTPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDRFPANESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 338 - protein, 505 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESMFSDQREYICSVIFLCICRDNQVVDYLIDPFVAGTSGGDPESLSIRHAFPALWNLENKYGSVIAGAILSKLSTKGDSVKTGGASPGKGRDKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGKSMKAPLLYKRNLRYLKHIPVD

SEQ ID NO: 339 - protein, 461 aa, Salinibacter; identical to SEQ ID NO: 53

SEQ ID NO: 340 - protein, 469 aa, Rhodothermus; identical to SEQ ID NO: 51

SEQ ID NO: 341 - protein, 483 aa, Tribolium <grass>
NMSLRLVLFLVFCIGKVLGNFSVIVIGAGPSGIAAATKLLQHSVNVTVLEAENRIGGRINTVKFGDGLVELGAEYCHGEVGNIVKELVNGYDLLEPNFNYLNGEIYYSNGSKLDHGFVREMQDLILSENKEENYDTRGKSIGEVFMHKYNSTLVEKYKSDENKLKLLKEGLHFAERSILISEGSFSWFDASADSDWLECPGNQTLVWKGVGYKTVLEILMKSYPNPDEKLPLDDKLFLNSKVTKINWGEKPIKVHTSDKVYSADYVIFTPSIGVLKAGSDLFTPSLPPKKHKAIDSIGFAGVVKLFLRFPVKWWDDNDKYFAFFWSDDDLKSENFPEGPPEKRKIVGYPAVGLVPSWAQHQRLDDLDLGEMVPEIEQLPIETLKKGVNFTLEKFLGKDYNITEIGEVLRSGWVTNENFRGTYSFTRNGLYQKGVSYQNDLAEPLEGLFFAGEATNPVHFATVHGAIESGHREARRILDPRNKN

SEQ ID NO: 342 - protein, 453 aa, Tribolium <grass>
SVIIVGAGVSGISAAVKLFENGIANLKIFEAEDRIGGRIHTVKFGDNFIDLGAQYCHGENVVYDTVKDLDLLEHAQLFSTPKMYYSNGSHLDNQLTQDLQKVVSSYDHDITRSKELSLGDAFLKKYNSTILEKYKNDPENFKLASDGLTFAHSTILMHEGAFHWSRPASGRHYKAVKGDQMMVWKQRGYDMILDVLLKRYPDPSLKIPIEEKLFLNKRVTKITWTGDKASVKLSDGTSHEADHVIFTPSVGVLTHDDLFEPVVPPRKQQAIKSMGFDGIIKLILYFPEKWWHDSDSTFFFLWDRKDLEGITKEFNEGPSKDGISWVSNLVALVKVPSNPHVLIGWVSGGLIPEMEKMSLDVVKKGSMFVIRKFLGRDYNVTEPGEVLWSDWHNNPNFRGTYSYEKNGYFEEEVHYQDHLAEPLTQGTTPVVLFAGEATHPTHYSTVHGAIESG

SEQ ID NO: 343 - protein, 612 aa, Mycosphaerella
MASSSSPNHGKKAIVIGAGVGGVSTAARLAAAGFSVTVLEKNSFTGGRCSLIHHDGYRFDQGPSLLLLPHLFHATFADLGTTLEKEGVHLLKCEPNYNIHFGDGEKFTLSTDLSVMKEEIEKWEGKDGYDRYLAFLRESHAHYELSVTHVLLKNFTSLLSMLRISFLQHLVALHPFESIWSRASRYFWTERLRRVFTFGSMYMGMSPFDAPGTYSLLQYTELAEGIWYPVGGFHKVVGALVGIAERMGAEFRLETAVKRICVTADGARATGVELENGEVLEADVVVNNSDLVYAYNHLLQPQAYAESLSDRPGSCSSISFYWALDRKVPELSAHNIFLADDYRESFDSIFKKHLIPDQPSFYVNVPSRVDSTAAPEGKDTVVVLVPVGHLTGEAAASHFSQPASSPSKPNGGTIKSASPSTQTGIPPTLDQDWPAMIALARQTIIKTIHHRTGVDLHPLIIHEQSNDPVTWRSAFNLDKGAILGLSHSFFNVLCFRPSTRARRAGPLDPLLKYLSGLYMVGASAHPGTGVPIVLAGGKLVAEQVCGDMGVRVPWVVEEGRGKGKEEVKKLDRMEKPETWVKWVGILIALGMVPWILGWVVVLFLAKVASVGW

SEQ ID NO: 344 - protein, 936 aa, Mycosphaerella
MSIDTEEATCQVPVELSAGSESEEELNDIAEHELEDDFDPHFHREGQATPMVDIAGPASESQHQQPPAFSRWVSKLRRKRHNHPQLLSPRKERWTLDDFDTRAASPGQQYLSPGRHYHSDSQGSSVRFVTAVRSATATLASASMATLSRRTTRFRRGHQRSSIVSGSEIRLSIESRRSIIDEAAKQRARKRREKLEELIRTEESYVADVKALSNAYFTILAHQPTATSFARTSTQRTIADILHLHDDILGCLHRIVPFAEYDQTIARLPLPLRAHNRWHSMDAVPQRTTPNRSTLATIRQGRRSLNISRSSSDDAQVVLRCSPQTIAAVAKAFSDNMLRFAAYEDYGANYDLIQRDVDDTQRAISGWADFDKAIEAISAHVNPMRTREANRKRAMTVKDLLIKPIQRLPRYELLFSDLHKLTPACDDPISHAEIEELRLKLNSVCHRMNAAKENPARARALEMTWLIGDRLTFSSQVPRSIFLQLLGRVSLCGSLYIAYRSRDRIKGAYVICVLFESCLLLASCDEDQSKYSILVSITLANATIEETDNAKGLQCHTAPHAWKVVFEQGARMYELIFTACSAVESEVWRTHIASGIETQIAAVAEGKANVFELQSPLTADMKSIGKAFGKPGSFVRRMSVQRAATIGPTADLNQVIIKNTQAVKEVMDNSSQGSFQIPRSQSVATPSHVQTLAPRRADRHRLETILSDVWSRDLLPYPGMVRRSDPIRAGANHVIRKFSMASITSNFSSSKRTGSYTSMSSWRKEDMPPPRNRGESGREGSSMSSRQSRPPLIDFHTAPDAFLPADFEIGRPSKDKRKRSALRTFTMTMERPFTPLLGNENKQSGLRRAQSVKDVVDDQARPGPSPIQLKRREEKRTGTPVYSVVQERARTPAMLHVKDESLEMGMGVGEASNGAVAGKAPRKSKSRLLRLFGQER

SEQ ID NO: 345 - protein, 573 aa, Mycosphaerella
MLHSRSCTYRLLAPAVARRITPLVPSQCLLQTHRSRTYSAEAAPSHDVAVLGGGITGLAAAHYVTREHPRAKVTLYEASDRVGGWVSSKRADVHDGTVLFEGGPRTLRPNGNGVLAANASQMQELDLTKDAIFTQKSSPAAQNRFVYYPDHIVRMPHPSAGLFNNLWSLMTEPVFATALKSGFMEAFTTGRDGSIQDESIAEFFSRRLSPTMVDRILSAVIHGIYAGDVNKLSAKSLFPNQWRHEAKYDSLIKGVIQERAEGTMVTKREADFLQAMKVFEWDPLLKATLKDNSVFTFKDGLQMLPDRLHSRLFEDGRVEFKTGSPVESIVQSQGNSGIQVTTKGSTESKTHTHVISALSPEHLNTVCRHGSASSRLIDSIPTVTVMTVSMYFRTPDLHEPGFGYLIPQATPFENNPERALGVVFDTAYSPGSSDSRGTKVTVMLGGHWWDGWPAFPDEEEGVTMARAVLERHLGIKEAPEAWQVNLQADCIPQYTVGHETRLKKAHNNIWQEYKGRLRVAGNWMSGVGVNDCLRSAYEVARNLSKDGTGLQHVGEAPTLRMKPVRPGEKTEES

SEQ ID NO: 346 - protein, 239 aa, Apisum
KREGGIEKNQSIQIIEASDHTGGWIQSWKDENTNVISELGPRTIRGRGKSANNTYSLIKDLGIEDLVRNVGIDASARYIFANGNIHQLPMSVWKALFTVNQPFTKPWIYYVLRECFSSNNSKDKLSDVQNNDESAYDFFCRTFGQEFADYLISPLLCGVCGGNAKQMSVKFMFGALYEAERKHGTVGLGLLKEQLSSIWNREKVKDTKGTNTVKPPPSVYYLDGGLQRLIHALDIENES

SEQ ID NO: 347 - protein, 502 aa, Schizophyllum
MAPHHIAVLGGGLTGLSSAYHLSHRFPNALITLVERSTRVGGWAESERVSLKDPKDGSEASILIEGGPRTLRPTAKSVLELVTRLDLLDDLILVPRTSPSAKNKYFHMPGQPGLLAVPSSFKGLISSPLGACLTRAVAKEAMAFSNRDDLKDESFDSFLCRRFTAEFAEKVGSALVHGIFAADSRKLSVRAAFPVLWEAEEYGWGSVVRGFIRGRREEDVEESYYISNPVQKAMEETAVFSFRNGMDTVARATEHHLSKLKNVTILKGADVKSLGVNSKDKSIEVQIRPTHVVSTLPLPALHRVLTPTSNLPHLTTNPYSTVTVYNLIFRTDTPTPIHPAGFGYLIPRPPGGYEQPQANKEGILGCVFDSCALSAQDVMPGPTKYTKMTVMTGGPYQNKPPALDTVLQALARHLDWPEVYEPVYTRVRENRDCIPVPAPGHLERVAELRRVLKEGEWQGRMEVVGAGVGGVSVGDCVEAGRWVGEGWGPSTPQMEDDECDDE

SEQ ID NO: 348 - protein, 150 aa, Acinetobacter
MDAPSDAFLWVKALHIIAVVCWFAALFYLPRLYVYHAMSEDDTSHRRFEVMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 349 - protein, 150 aa, Acinetobacter
MDAPSDAFLWVKALHIIAVVCWFAALFYLPRLYVYHAMSEDEISHRRFEIMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 350 - protein, 150 aa, Acinetobacter
MDAPSDAFLWVKALHIIAVVCWFAALFYLPRLYVYHAMSEDEISHRRFEIMERKLYRGIMWPSMIATLITAHFLVDWGDATRHYHQALWFYIKVGLVGLLVIYHFVCGYYRKKLIGNAHYKSHKFWRYFNEMPTLILFAVVILVVVKPQF

SEQ ID NO: 351 - protein, 150 aa, Acinetobacter
MDAPSDAFLWVKALHIIAVVCWFAALFYLPRLYVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 352 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 353 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGMVGLLVIYHFVCGYYRKKLIGNAHYKSHKFWRFFNEMPTLILFAVVILVVVKPQF

SEQ ID NO: 354 - protein, 150 aa, Acinetobacter
MDAPSDAFLWVKALHIIAVVCWFAALFYLPRLYVYHAMSEDVVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 355 - protein, 150 aa, Acinetobacter
MDAPSDAFLWVKALHIIAVVCWFAALFYLPRLFVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 356 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDASRHYHEALWFYLKVGLVGLLVIYHFVCGYYRKKLIGNAHYKSHKFWRFFNEMPTLILFAVVILVVVKPQF

SEQ ID NO: 357 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 358 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDATRHYHEALWFYLKVGLVGLLVIYHFICGYYRKKLIGNAHYKSHKFWRFFNEMPTLILFAVVILVVVKPQF

SEQ ID NO: 359 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKSHKFWRFFNEMPTLILFAVVILVVVKPQF

SEQ ID NO: 360 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDASRHYHEALWFYLKVGLVGLLVIYHFVCGYYRKKLIGNAHYKSHKFWRFFNEMPTLILFAVVILVVVKPQF

SEQ ID NO: 361 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVILVVVKPQF

SEQ ID NO: 362 - protein, 150 aa, Acinetobacter
MDAPSDAFLWVKALHIIAVVCWFAALFYLPRLFVYHAMSEDALSHQRFEVMERKLYRGIMWPSMIATLITAHFLVDWGDATRHYHDALWFYLKVGLVGLLVIYHFVCGYYRKKLIGNAHYKSHKFWRFFNEMPTLILFAVVILVVVKPQF

SEQ ID NO: 363 - protein, 150 aa, Acinetobacter
MDAPSDAFLWVKALHIIAVVCWFAALFYLPRLYVYHAMSEDAISHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVILVVVKPQF

SEQ ID NO: 364 - protein, 150 aa, Acinetobacter
MDAPSDAFLWVKALHIIAVVCWFAALFYLPRLYVYHAMSEDKVSHQRFEVMERKLYRGIMWPSMLATLITAHFLVDWGDATRHYHEALWFYLKVGLVGLLVIYHFVCGYYRKKLISNAHYKSHQFWRFFNEMPTLILFAVVILVVVKPQF

SEQ ID NO: 365 - protein, 150 aa, Acinetobacter
MDAPSDAFLWVKALHIIAVVCWFAALFYLPRLYVYHAMSEDEISHQRFEVMERKLYRGIMWPSMIATLVTAHFLVEWGDATRHYHEAIWFYLKVGLVGLLVIYHFVCGYYRKKLIGNAHYKSHKFWRFFNEMPTLLLFAIIILVVVKPQF

SEQ ID NO: 366 - protein, 150 aa, Acinetobacter
MDAPSDAFLWVKALHIIAVVCWFAALFYLPRLYVYHAMSEDAISHQRFEVMERKLYRGIMWPSMIATLVTAHFLVEWGDATRHYHEALWFYLKVGLVGLLVIYHFVCGYYRKKLIGNAHYKSHKFWRFFNEMPTLLLFAIIILVVVKPQF

SEQ ID NO: 367 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 368 - protein, 150 aa, Acinetobacter
MDAPSDAFLWVKALHIIAVVCWFAALFYLPRLYVYHAMSEDAISHQRFEVMERKLYRGIMWPSMIATLLTAHFLVDWGDATRHYHEALWFYMKVGLVGLLVIYHFVCGYYRKKLIGNAHYKSHRFWRFFNEMPTLLLFAIIILVVVKPQF

SEQ ID NO: 369 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHDALWFYLKVGLVGLLVIYHFVCGYYRKKLIGHAHYKSHKFWRFFNEMPTLILFAVVILVVVKPQF

SEQ ID NO: 370 - protein, 150 aa, Acinetobacter
MDAPSEAFLWVKALHIIAVVCWFAALFYLPRLYVYHAMSEDTVSHQRFEIMERKLYRGIMWPSMIATLITAHFLVDWGDATRHYHEALWFYLKVGLVGLLVIYHFVCGYYRKKLIGNAHYKSHKFWRFFNEMPTLILFAVIILVVVKPTF

SEQ ID NO: 371 - protein, 150 aa, Acinetobacter
MDAPSDAFLWVKALHIIAVVCWFAALFYLPRLYVYHAMSEDAISHQRFEVMERKLYRGIMWPSMIATLVTAHFLVEWGDATRHYHEAIWFYLKVGLVGLLVIYHFVCGYYRKKLIGNAHYKSHKFWRFFNEMPTLLLFAIIILVVVKPQF

SEQ ID NO: 372 - protein, 150 aa, Acinetobacter
MDAPSDAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 373 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHDALWFYLKVGLVGLLVIYHLVCGYYRKKLIGNAHYKSHRFWRFFNEMPTLILFAVVILVVVKPQF

SEQ ID NO: 374 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIGNAHYKSHKFWRYFNEMPTLILFAVVILVVVKPTF

SEQ ID NO: 375 - protein, 150 aa, Acinetobacter
MDAPSDAFLWVKALHIIAVVCWFAALFYLPRLFVYHAMSEDALSHQRFEVMERKLYRGIMWPSMIATLITAHFLVDWGDATRHYHDALWFYLKVGLVGLLVIYHLVCGYYRKKLIGNAHYKSHKFWRFFNEMPTLILFAVVILVVVKPQF

SEQ ID NO: 376 - protein, 150 aa, Acinetobacter
MDAPSDAFLWVKALHIIAVVCWFAALFYLPRLYVYHAMSEDAASHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 377 - protein, 150 aa, Acinetobacter
MDAPSDAFLWVKALHIIAVVCWFAALFYLPRLYVYHAMSEDEISHQRFEVMERKLYRGIMWPSMIATLVTAHLLVEWGDATRHYHEAIWFYLKVGLVGLLVIYHFVCGYYRKKLIGNAHYKSHKFWRFFNEMPTLLLFAIIILVVVKPQF

SEQ ID NO: 378 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKIGLVALLVVYHFVCGYYRKKLIGNAHYKSHKFWRFFNEMPTLILFAVVILVVVKPQF

SEQ ID NO: 379 - protein, 150 aa, Unknown
  Bacteria
MDAPSDAFLWVKALHIIAVVCWFAALFYLPRLYVYHAMSDDAVSHQRFEVMERKLYRGIMWPAMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 380 - protein, 150 aa, Acinetobacter
MDAPSDAFLWVKALHIIAVVCWFAALFYLPRLYVYHAMSEDAISHQRFEVMERKLYRGIMWPAMLATLITAHFLVDWGDATRHYHEALWFYLKVGLVGLLVIYHLVCGYYRKKLIGNAHYKSHKFWRYFNEMPTLILFAVVILVVVKPTF

SEQ ID NO: 381 - protein, 150 aa, Acinetobacter
MDAPSDAFLWVKALHIIAVVCWFAALFYLPRLYVYHAMSDDATSHQRFEIMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 382 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHEALWFYLKVALVGLLVIYHLVCGYYRKKLIGNAHYKSHKFWRFFNEMPTVILFAVVILVVVKPQF

SEQ ID NO: 383 - protein, 150 aa, Acinetobacter
MDAPSDAFLWVKALHIIAVVCWFAALFYLPRLYVYHAMSDDTVSHQRFEVMERKLYRGIMWPSMVATLITAHFLVDWGDATRHYHEALWFYIKVALVGLLVIYHFVCGYYRKKLIGNAHYKSHKFWRFFNEMPTLILFAVVILVVVKPHF

SEQ ID NO: 384 - protein, 150 aa, Acinetobacter
MDAPSDAFLWVKALHIIAVVCWFAALFYLPRLYVYHAMSEDAASHQRFEVMERKLYRGIMWPSMIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 385 - protein, 150 aa, Acinetobacter
MDAPSEAFLWVKALHIIAVVCWFAALFYLPRLFVYHAMSDDNLSHQRFEIMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 386 - protein, 150 aa, Acinetobacter
MDAPSDAFLWVKALHIIAVVCWFAALFYLPRLYVYHAMSDDATSHHRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 387 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 388 - protein, 150 aa, Acinetobacter
MDAPSNAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 389 - protein, 150 aa, Acinetobacter
MDAPSDAFLWVKALHIIAVVCWFAALFYLPRLYVYHAMSEDVISHQRFEVMERKLYRGIMWPSMIATLLTAHFLVDWGDATRHYHEALWFYLKVSLVGLLVIYHFVCGYYRKKLIGNAHYKSHRFWRFFNEMPTLLLFAIIILVVVKPQF

SEQ ID NO: 390 - protein, 150 aa, Acinetobacter
MDAPSDAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTFILFAVVILVVVKPQF

SEQ ID NO: 391 - protein, 150 aa, Acinetobacter
MDAPSDAFLWVKALHIIAVVCWLAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 392 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGHAHYKSHKFWRFFNEMPTLILFAVVILVVVKPTF

SEQ ID NO: 393 - protein, 150 aa, Acinetobacter
MDAPSDAFLWVKALHIIAVVCWFAALFYLPRLYVYNAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 394 - protein, 150 aa, Acinetobacter
MDAPSDAFLWVKALHIIAVVCWFAALFYLPRLYVYHAMSDDAASHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 395 - protein, 150 aa, Acinetobacter
MDAPSDAFLWVKALHIIAVVCWFAALFYLPRLYVYHAMSDDAASHQRFEVMERKLYRGIMWPSMIATLITAHFLVEWGDATRHYHEATWFYLKVGLVALLVVYHFVCGYYRKKLIGNAHYKSHKFWRFFNEMPTLILFAVVILVVVKPQF

SEQ ID NO: 396 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHEATWFYLKVGLVALLVVYHLVCGYYRKKLIGNAHYKSHKFWRFFNEMPTLILFAVVILVVVKPQF

SEQ ID NO: 397 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLINNAHYKSHKFWRYFNEMPTLILFAVVILVVVKPTF

SEQ ID NO: 398 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVALLVIYHLVCGYYRKKLIGNAHYKSHKFWRFFNEMPTLILFAVVILVVVKPQF

SEQ ID NO: 399 - protein, 150 aa, Acinetobacter
MDAPSDAFLWVKALHIIAVVCWFAALFYLQRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 400 - protein, 150 aa, Acinetobacter
MDAPSEAFLWVKALHIIAVVCWFAALFYLPRLFVYHAMSDDNLSHQRFEIMERKLYRGIMWPSMIATLITAHFLVDWGDATRHYHEALWFYLKVGLVGLLVIYHFACGYYRKKLIGNAHYKSHKFWRFFNEMPTLILFAVVILVVVKPTF

SEQ ID NO: 401 - protein, 150 aa, Acinetobacter
MDAPSDAFLWVKALHIIAVVCWFAALFYLPRLYVYHAMSEDTASHQRFEVMERKLYRGIMWPSMIATLITAHFLVDWGDATRHYHQATWFYLKVGLVALLVIYHLACGYYRKKLIGNAHYKSHKFWRFFNEMPTLILFAVIILVVVKPQF

SEQ ID NO: 402 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 403 - protein, 150 aa, Acinetobacter
MDAPSDAFLWVKALHIIAVVCWFAALFYLPRLYVYHAMSKDAASHQRFEVMERKLYRGIMWPSMIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 404 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIDNAHYKSHKFWRYFNEMPTLILFAVVILVVVKPTF

SEQ ID NO: 405 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVTLLVIYHLVCGYYRKKLIGNAHYKSHKFWRFFNEMPTLILFAVVILVVVKPQF

SEQ ID NO: 406 - protein, 150 aa, Acinetobacter
MDAPTDAFLWVKALHIIAVVCWFAALFYLPRLYVYHAMSEDTISHQRFEVMERKLYRGIMWPSMIATLITAHFLVDWGDATQHYHQAVWFYLKVALVALLVIYHFVCGYYRKKLIGNAHYKSHKFWRFFNEMPTLILFAVVILVVVKPQF

SEQ ID NO: 407 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYNLVCGYYRKKLIGNAHYKSHKFWRFFNEMPTLILFAVVILVVVKPQF

SEQ ID NO: 408 - protein, 150 aa, Acinetobacter
MDAPSDAFLWVKALHIIAVVCWFAALFYLPRLYVYHAMSDDAVSHQRFEVMERKLYRGIMWPSMIATLITAHFLVEWGDATRHYHEALWFYLKVGLVGLLVIYHFVCGYYRKKLIGHAHYKSHKFWRFFNEMPTLILFAVVILVVVKPTF

SEQ ID NO: 409 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHDATWFYLKVGLVALLVIYHLVCGYYRKKLIGNAHYKSHKFWRFFNEMPTLILFAVVILVVVKPQF

SEQ ID NO: 410 - protein, 150 aa, Acinetobacter
MDAPSDAFLWVKALHIIAVVCWFAALFYLPRLYVYHAMSDDAASHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 411 - protein, 150 aa, Acinetobacter
MDVPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 412 - protein, 150 aa, Acinetobacter
MDAPSDAFLWVKALHIIAVVCWFAALFYLPRLYVYHAMSEDTVSHQRFEVMERKLYRGIMWPAMLATLITAHFLVDWGDATRHYHEALWFYLKVGLVGLLVIYHLVCGYYRKKLIDNAHYKSHKFWRYFNEMPTLLLFAVVILVVVKPTF

SEQ ID NO: 413 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVALLMIYHLVCGYYRKKLIGNAHYKSHKFWRFFNEMPTLILFAVVILVVVKPQF

SEQ ID NO: 414 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIDNAHYKSHKFWRYFNEMPTLLLFAVVILVVVKPTF

SEQ ID NO: 415 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVGLVALLVIYHLACGYYRKKLIGNAHYKSHKFWRFFNEMPTLILFAVVILVVVKPQF

SEQ ID NO: 416 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVGLVALLVIYHLVCGYYRKKLIGNAHYKSHRFWRFFNEMPTLILFAVVILVVVKPQF

SEQ ID NO: 417 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLICGYYRKKLINNAHYKSHKFWRYFNEMPTLILFAVVILVVVKPTL

SEQ ID NO: 418 - protein, 150 aa, Acinetobacter
MDAPSDAFLWVKALHIIAVVCWFAALFYLPRLYVYHAMSDDAISHQRFEVMERKLYRGIMWPAMIATLITAHFLVDWGDATRHYHEALWFYLKVGLVGLLVIYHLMCGYYRKKLIDNAHYKSHKFWRYFNEMPTLILFAVVILVVVKPTF

SEQ ID NO: 419 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVALVALLVIYHLVCGYYRKKLIGNAHYKSHKFWRFFNEMPTLILFAVVILVVVKPQF

SEQ ID NO: 420 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIRHAHYKSHKFWRFFNEMPTLILFAVVILVVVKPTF

SEQ ID NO: 421 - protein, 150 aa, Acinetobacter
MDAPSDAFLWVKALHIIAVVCWFAALFYLPRLYVYHAMSEDTVSHERFQVMERKLYRGIMWPAMVATLITAHFLVDWGDATRHYHEALWFYLKVGLVGLLVIYHLVCGYYRKKLIENAHYKSHKFWRFFNEMPTLILFAVVILVVVKPTF

SEQ ID NO: 422 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLVIYHLVCGYYRKKLIGNAHYKSHRFWRFFNEMPTLILFAVVILVVVKPQF

SEQ ID NO: 423 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVALVALLVIYHLACGYYRKKLIGNAHYKSHKFWRFFNEMPTLILFAVVILVVVKPQF

SEQ ID NO: 424 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGHYRKKLMENAHYKSHKFWRYFNEMPTLILFAVVILVVVKPTF

SEQ ID NO: 425 - protein, 150 aa, Acinetobacter
MDAPSDAFLWVKALHIIAVVCWFAALFYLPRLYVYHAMSEDVVSHQRFEIMERKLYRGIMWPAMVATLITAHFLVDWGDATRHYHEALWFYLKVGLVGLLVIYHLVCGYYRKKLMENAHYKSHKFWRFFNEMPTLILFAVVILVVVKPTF

SEQ ID NO: 426 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLIIYHLVCGYYRKKLIGNAHYKSHRFWRFFNEMPTLILFAVVILVVVKPQF

SEQ ID NO: 427 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVALVALLVIYHLVCGYYRKKLIGNAHYKSHRFWRFFNEMPTLILFAVVILVVVKPQF

SEQ ID NO: 428 - protein, 150 aa, Acinetobacter
MDAPTDAFLWVKALHIIAVVCWFAALFYLPRLYVYHAMSEDTISHQRFEVMERKLYRGIMWPSMIATLITAHFLVDWGDGTQHYHQAGWFYLKVALVALLVIYHFVCGYYRKKLIGNAHYKSHKFWRFFNEMPTLILFAVVILVVVKPQF

SEQ ID NO: 429 - protein, 150 aa, Acinetobacter
MDAPSDAFLWVKALHIIAVVCWFAALFYLPRLYVYHAMSEDAASHQRFEIMERKLYRGIMWPSLIATLITAHFLVDWGDATRHYHQATWFYLKVALVALLVIYHLACGYYRKKLIGNAHYKSHKFWRFFNEMPTLILFAVVILVVVKPQF

SEQ ID NO: 430 - protein, 150 aa, Acinetobacter
MDAPSDAFLWVKALHIIAVVCWFAALFYLPRLYVYHAMSEDVVSHQRFEIMERKLYRGIMWPAMVATLITAHFLVDWGDATRHYHEALWFYLKVGLVGLLVIYHLICGYYRKKLMENAHYKSHKFWRFFNEMPTLILFAVVILVVVKPTF

SEQ ID NO: 431 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLVIYHLVCGYYRKKLIGNAHYKSHRFWRFFNEMPTVILFAVVILVVVKPQF

SEQ ID NO: 432 - protein, 150 aa, Acinetobacter
MDAPSDAFLWVKALHIIAVVCWFAALFYLPRLYVYHAMSEDTLSHQRFEIMERKLYRGIMWPSMIATLITAHFLVDWGDATRNYHDALWFYLKVALVGLLVIYHLVCGYYRQKLIGNAHYKSHKFWRFFNEMPTVLLLAIVILVVVKPQF

SEQ ID NO: 433 - protein, 150 aa, Acinetobacter
MDAPSDAFLWVKALHIIAVVCWFAALFYLPRLYVYHAMSEDAVSHARFQVMERKLYRGIMWPAMLATLITAHFLVDWGDATRHYHEAVWFYLKVGLVGLLVIYHLVCGHYRKKLMENAHYKSHKFWRYFNEMPTLILFAVVILVVVKPTF

SEQ ID NO: 434 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRNYHDALWFYLKVALVGLLVIYHLVCGYYRLKLIGNAHYKSHKFWRFFNEMPTVLLFAIVILVVVKPVF

SEQ ID NO: 435 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVVLVVVKPQF

SEQ ID NO: 436 - protein, 150 aa, Acinetobacter
MDAPSSAFLWVKALHIIAVVCWFAALFYLPRLYVYHAMSKDQASYERFQIMERKLYRGIMWPAMIATLITAHFLVDWGDATRHYHEALWFYFKVGLVGLLIIYHFVCGYYRKKLIDNAHYKTHKFWRMFNELPTVILFAVVILVVVKPQF

SEQ ID NO: 437 - protein, 149 aa, Acinetobacter
MNAPSDAFFWIKALHIIAVVCWFAALFYLPRLYVYHAMSDDTVSHQRFEVMERKLYRGIMWPAMIATLITAHFLVDWGDQFYHYHEALWFYLKVALVGLLVIYHFVCGYYRKKLIGNAHYKTHKFWRFFNEMPTLLLFAIVILVVVKPF

SEQ ID NO: 438 - protein, 150 aa, Acinetobacter
MDAPSDAFLWVKALHIIAVVCWFAALFYLPRLYVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILLAVVILVVVKPQF

SEQ ID NO: 439 - protein, 142 aa, Acinetobacter
MWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 440 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILVAVIILVVVKPQF

SEQ ID NO: 441 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHEALWFYLKVALVGLLVIYHLVCGYYRKKLIGNAHYKSHKFWRFFNEMPTVILLAVVILVVVKPQF

SEQ ID NO: 442 - protein, 150 aa, Acinetobacter
MDAPSDAFLWVKALHIIAVVCWFAALFYLPRLYVYHAMSEDGTSHQRFQIMERKLYRGIMWPSMLATLITAHFLVDWGDATRHYHEALWFYLKVGLVGLLVIYHFVCGYYRKKLMENPHYKSHKFWRFFNEMPTLILLAVVILVVVKPQF

SEQ ID NO: 443 - protein, 150 aa, Acinetobacter
MNAPSEAFLWVKALHIIAVVCWFAALFYLPRLYVYHAMSDDDASHQRFEVMERKLYRGIMWPAMIATLITAHFLVDWGDATYHYHEALWFYLKVGLVGLLVIYHFVCGYYRKKLIGNAHYKSHKFWRVFNEMPTLILLAVVILVVVKPTF

SEQ ID NO: 444 - protein, 148 aa, Acinetobacter
MVSEAFLWVKALHIIAVVCWFAALFYLPRLYVYHAMSDDLASHQRFEVMERKLYRGIMWPAMIATLITAHFLVDWGDATQHYHEATWFYIKVALVGLLVIYHFVCGYYRKKLIGNAHYKSHKFWRFFNEMPTLLLLAIVILVVVKPQF

SEQ ID NO: 445 - protein, 150 aa, Acinetobacter
MNAPSDAFLWVKALHIIAVVCWFAALFYLPRLYVYHAMSDDAISHQRFQVMERKLYRGIMWPAMIATLITAHFLVAWGDATQHYHLAHWFYVKVALVGLLVIYHFVCGYYRKKLIENAHYKSHKFWRFFNEMPTVILLAVVILVVVKPQF

SEQ ID NO: 446 - protein, 150 aa, Acinetobacter
MNAPSDAFLWVKALHIIAVVCWFAALFYLPRLYVYHAMSDDAISHQRFQVMERKLYRGIMWPAMIATLITAHFLVAWGDATQHYHLAHWFYLKVALVGLLVIYHFVCGYYRKKLIENAHYKSHKFWRFFNEMPTVILLAVVILVVVKPQF

SEQ ID NO: 447 - protein, 150 aa, Acinetobacter
MDVPSDAFLWVKAFHIISIVCWFAALFYLPRLYVYHAMSNDAVSHQRFQVMERKLYRGIMWPSMIATLITAHFLVDWGDATQHYHEALWFYLKLGLVGLLVIYHLFCGYYRQKLILDAHYKSHKFWRFFNEMPTFILVAVIILVVVKPHF

SEQ ID NO: 448 - protein, 181 aa, Escherichia
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 449 - protein, 181 aa, Escherichia; identical to SEQ ID NO: 448

SEQ ID NO: 450 - protein, 181 aa, Enterobacter
MKTLILFSTRDGQTREIASYLASELKELGIQADVTNVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 451 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVYTDWEQVANFAREIAHLTDKPTLK

SEQ ID NO: 452 - protein, 181 aa, Escherichia
MKTLILFSTRDGQTREIAAYLASELKELGIQADVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 453 - protein, 180 aa, Shigella
MKTLILFSTRDGQTREISSYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVTDWEQVANFAREIAHLTDKPTLK

SEQ ID NO: 454 - protein, 181 aa, Escherichia
MKTLILFSTRDGQTREIASYLASELKELGIQADVANVHRTEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 455 - protein, 181 aa, Escherichia
MKTLILFSTRDGQTREIASYLASELKELGIQADVANVHRIEEPQWENYDRVVIGASIRYGHYHSAFQEFVKKHATQLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTPK

SEQ ID NO: 456 - protein, 181 aa, Shigella
MKTLILFSTRDGQTREIASYLASELKELGIQTDVANVHRIEEPQWENYGRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVYTDWEQVANFAREIAHLTDKPTLK

SEQ ID NO: 457 - protein, 181 aa, Escherichia
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWQQVENFAREIAHLTDKPTLK

SEQ ID NO: 458 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAQLTNKPTLK

SEQ ID NO: 459 - protein, 181 aa, Escherichia
MKTLILFSTRDGQTREIASYLASELKELGIQADVANVHRTEEPQWENYDRVVIGASIRYGHYHSAFEEFVKKHETRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 460 - protein, 181 aa, Escherichia
MKTLILFSTRDGQTREIASYLASELKELGILADVANVHRTEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTMK

SEQ ID NO: 461 - protein, 181 aa, Enterobacter
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAQLTNKPTLK

SEQ ID NO: 462 - protein, 181 aa, Shigella
MKTLILFSTRDGQTREIASYLASELKELGIQTDVANVHRIEEPQWKNYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAQLTNKPTLK

SEQ ID NO: 463 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYCWYDRFMIKLIMKMSGGETDTRKEVVYTDWEQVANFAREIAQLTNKPTLK

SEQ ID NO: 464 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTRKEVVYTDWEQVANFAREIAHLTNKSSAK

SEQ ID NO: 465 - protein, 161 aa, Shigella
MASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 466 - protein, 181 aa, Citrobacter
MKTLILFSTRDGQTREIASYLASELKELGIWADVVNLHRTEEPEWDSYDRVVIGASIRYGHYHTAFQEFVKKHATRLNGMPSAFYSVNLVARKPEKRTPQTNSYARKFLMSSQWRPDRCAVIAGALLYPRYRWYDRIMIKLIMKMSGGETDTNKEVIYTDWEQVAGFAREIAQLTVKSPVK

SEQ ID NO: 467 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKMSGGETDTSKEVVYTDWEQVANFAREIAHLTNKSSAK

SEQ ID NO: 468 - protein, 181 aa, Citrobacter
MKTLILFSTRDGQTREIASYLASELKELGIWADVINLHRTEELDWQSYDRVVIGASIRYGHYHAAFQEFVKKHATRLNAMPSAFYSVNLVARKPEKRTPQTNSYARKFLMSSQWRPDLCAVIAGALRYPRYRWYDRLMIKLIMKMSGGETDTSKEVVYTDWEQVANFARDIAQLTNKSLAK

SEQ ID NO: 469 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKMSGGETDTSKEVVYTDWDQVANFAREIAHLTNKSSAK

SEQ ID NO: 470 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKLSGGETDTSKEVVYTDWEQVANFAREIAHLTNKSSAK

SEQ ID NO: 471 - protein, 181 aa, Salmonella
MKTLILFSTRDGQTREIASYLASELKEMGIWADVVNLHRAEEPDWDKYDRVVIGASIRYGHYHSAFQEFVKKYSTRLNGMPSAFYSVNLVARKPEKRTPQTNSYARKFLMNSPWRPDHCAVIAGALRYPCYRWYDRLMIKLIMKMSGGETDTSKEVVYTDWDQVAKFAREIAHLTNKPSSK

SEQ ID NO: 472 - protein, 181 aa, Citrobacter
MKTLILFSTRDGQTREIASYLASELKELGIWADVINLHRTEELDWQSYDRVVIGASIRYGHYHAAFQEFVKKHATRLNAMPSAFYSVNLVARKPEKRTPQTNSYARKFLMSAQWRPDLCAVIAGALRYPRYRWYDRLMIKLIMKMSGGETDTSKEVVYTDWEQVANFARDIAQLTNKSLAK

SEQ ID NO: 473 - protein, 181 aa, Salmonella
MKTLILFSTRDGQTREIASYLASELKEMGIRADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 474 - protein, 181 aa, Citrobacter
MKTLILFSSRDGQTREIAAYLASELKELGIWADVFNLHRTEEPDWESYDRVVIGASIRYGHYHSAFLDFVKKHATRLNQMPSAFYSVNLVARKPEKRTPQTNSYARKFLMHSQWRPDRSAVIAGALLYPRYRWYDRIMIKLIMKMSGGETDTRKEVIYTDWEQVASFAREIAQLTDKSSVK

SEQ ID NO: 475 - protein, 181 aa, Salmonella
MKTLILFSTRDGQTREIASYLASELKEMGIWADVVNLHRAEEPDWDKYDRVVIGASIRYGHYHSAFQEFVKKYATRLNGMPSAFYSVNLVARKPEKRTPQTNSYARKFLMSSPWRPDHCAVIAGALRYPCYRWYDRLMIKLIMKMSGGETDTSKEVVYTDWDQVAKFAREIAHLTNKPSSK

SEQ ID NO: 476 - protein, 181 aa, Citrobacter
MKTLILFSTRDGQTREIASYLASELKALGIWADVINLHRTEELDWQSYDRVVIGASIRYGHYHAAFQEFVKKHATRLNAMPSAFYSVNLVARKPEKRTPQTNSYARKFLMSSQWRPDLCAVIAGALRYPRYRWYDRLMIKLIMKMSGGETDTSKEVVYTDWEQVANFARDIAQLTNKSLAK

SEQ ID NO: 477 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 478 - protein, 181 aa, Salmonella
MKTLILFSTRDGQTREIASYLASELKEMGIWADVVNLHRAEEPDWDCYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 479 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVSRKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 480 - protein, 181 aa, Salmonella sp.
MKTLILFSTRDGQTREIASYLASELKDMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 481 - protein, 181 aa, Salmonella
MKTLILFSTRDGQTREIASYLASELKEMGIWGDVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 482 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKFIMKMSGGETDTSKEVVYTDWEQVAHFAREIAHLTNKSSAK

SEQ ID NO: 483 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEAVYTDWEQVAHFAREIAHLTNKSSAK

SEQ ID NO: 484 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 485 - protein, 181 aa, Salmonella
MKTLILFSTRDGQTHEIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 486 - protein, 181 aa, Salmonella
MKTLILFSTRDGQTREIASYLASELKEMGIWADVVNLHRAEEPDWDSYDRVVIGASIRYGHYHSAFQEFVKKYAKRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 487 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMQMSGGETDTSKEVVYTDWEQVTHFAREIAHLTNKSSAK

SEQ ID NO: 488 - protein, 181 aa, Salmonella
MKTLILFSTWDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 489 - protein, 181 aa, Salmonella
MKTLILFSTRDGQTREIASYLASELKEMGIWADVVNLHRAEEPDWDKYDRVVIGASIRYGHYHSAFQEFVKKYATRLNGMPSAFYSVNLVARKPEKRTPQTNSYARKFLMSSPWRPDYCAVIAGALRYPCYRWYDRLMIKLIMKMSGGETDTSKEVVYTDWDQVAKFAREIAHLTNKLSSK

SEQ ID NO: 490 - protein, 181 aa, Salmonella
MKTLILFSTRDGQTREIASYLASELKEMGIWGDVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPSYRWYDRLMIKLIMKMSGGETDTSKEVVYTDWEQVAHFAREIAHLTNKSSAK

SEQ ID NO: 491 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLNNKSSAK

SEQ ID NO: 492 - protein, 181 aa, Salmonella
MKILILFSTRDGQTREIASYLASELKEMGIWADVVNLHRAEEPDWDSYDRVVIGASIRYGHYHSAFQEFVKKYAPRLNGMPSAFYSVNLVARKAEKRTPQTNSYARKFLMSSPWRPDHCAVIAGALRYPRYRWYDRLMIKLIMKMSGGETDTSKEVVYTDWDQVANFAREIAHLTNKSSAK

SEQ ID NO: 493 - protein, 181 aa, Citrobacter
MKTLILFSSRDGQTREIAAYLASELKELGICTDVVNLHRIEEPDWERYDRVVIGASIRYGHYHSAFLEFVKKHATRLNHMPSAFYSVNLVARKPEKRTPQTNSYARKFLMNSQWRPDRSAVIAGALLYPRYRWYDRMMIQLIMKMSGGETDTRKEVIYTDWEQVASFAREVAQLTPDSLVK

SEQ ID NO: 494 - protein, 176 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTN

SEQ ID NO: 495 - protein, 181 aa, Salmonella
MKTLILFSTRDGQTREIASYLASELKEMGIWADVVNLHRAEEPDWDSYDRVVIGASIRYGHYHSAFQEFVKKYATRLNGMSSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 496 - protein, 181 aa, Salmonella
MKTLILFSTRDGQTREIASYLASELKEMGIWADVVNLHRAEELDWDSYDRVVIGASIRYGHYHSSFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 497 - protein, 181 aa, Citrobacter
MKTLILFSSRDGQTREIAEYLASELKELGVWADVVNLHRTEEPDWKNYDSVVIGASIRYGHYHTAFQEFVKKHATRLNAMPSAFYSVNLVARKPEKRTPQTNSYARKFLMSSPWRPDRSAVIAGALLYPRYRWYDRVMIKLIMKMSGGETDTSKEVVYTDWEQVAIFAREIAQLTNKALLK

SEQ ID NO: 498 - protein, 181 aa, Citrobacter
MKTLILFSSRDGQTREIAAYLASELKELGVCTDVVNLHRTEEPDWERYDRVVIGASIRYGHYHSAFLEFVKKHATRLNHMPSAFYSVNLVARKPEKRTPQTNSYARKFLMNSQWRPDRSAVIAGALLYPRYRWYDRMMIQLIMKMSGGETDTRKEVIYTDWEQVASFAREIAQLTPDSVVK

SEQ ID NO: 499 - protein, 181 aa, Shigella
MKTLILFSSRDGQTREIAEYLASELKELGVWADVMNLHRTEEPEWKNYDSVVIGASIRYGHYHSAFQEFVKKHATQLNTMPSAFYSVNLVARKPEKRTPQTNSYARKFLMSSPWRPDHSAVIAGALLYPRYRWYDRVMIQLIMKMSGGETDTKKEVIYTDWEQVAGFAREIAQLTNKTLLK

SEQ ID NO: 500 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKASLK

SEQ ID NO: 501 - protein, 181 aa, Enterobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKTSLK

SEQ ID NO: 502 - protein, 174 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHL

SEQ ID NO: 503 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMGSPWRPDHSAVIAGALLYPRYRWYDRVMIQLIMKMSGGETDTNKEVVYTDWEQVARFAREIAQLTNKTSLK

SEQ ID NO: 504 - protein, 181 aa, Citrobacter
MKTLILFSSRDGQTREIAEYLASELKELGVWADVLNLHRTAEPDWQNYDSVVIGASIRYGHYHAAFQEFVKKHATRLNAMPSAFYSVNLVARKPEKRTPQTNSYARKFLMSSPWRPDRSAVIAGALRYPRYRWYDRVMIQLIMKMSGGETDTHKEVVYTDWEQVAGFAREIAQLTHKTVSK

SEQ ID NO: 505 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKALLK

SEQ ID NO: 506 - protein, 181 aa, Citrobacter
MKTLILFSSRDGQTREIAEYLASELKELGVWADVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTNKTLSK

SEQ ID NO: 507 - protein, 181 aa, Citrobacter
MKTLILFSSRDGQTREIAEYLASELKELGVWADVVNLHRTAEPDWQNYDSVVVGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTNKTLSK

SEQ ID NO: 508 - protein, 181 aa, Citrobacter
MKTLILFSSRDGQTREIAEYLASELKELGVWADVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVADFAREIAQLTHKTLSK

SEQ ID NO: 509 - protein, 181 aa, Citrobacter
MKTLILFSSRDGQTQEIAAYLASELKELGISTDVVNLHRTDEPDWERYDRVVIGASIRYGHYHSAFLAFVKKHATRLNRMPSAFYSVNLVARKPEKRTPQTNSYARKFLMNSQWRPDRSAVIAGALLYPRYRWYDRMMIQLIMKMSGGETDTRKEVIYTDWAQVASFAREIAQLTPDSLVK

SEQ ID NO: 510 - protein, 181 aa, Citrobacter
MKTLILFSSRDGQTREIAEYLASELKELGVWADVVNLHRTAEPDWQNYDSVVIGASIRYGHYHAAFQEFVKKYATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKALLK

SEQ ID NO: 511 - protein, 181 aa, Citrobacter
MKTLILFSSRDGQTREIAEYLASELKELGVWADVVNLHRTAEPDWQHYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVADFAREIAQLTHKTLSK

SEQ ID NO: 512 - protein, 181 aa, Citrobacter
MKTLILFSSRDGQTREIAEYLASELKELGVWTDVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTHKEVVYTDWEQVAGFAREIAQLTHKTLPK

SEQ ID NO: 513 - protein, 187 aa, Salmonella
MNNGVTRENIDSFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 514 - protein, 181 aa, Citrobacter
MKTLILFSSRDGQTREIAEYLASELKELGVWTDVVNLHRTAEPDWKNYDSVVIGASIRYGHYHSAFQEFVKKYATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTHKTLPK

SEQ ID NO: 515 - protein, 171 aa, Salmonella
DGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 516 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLTDNSRLK

SEQ ID NO: 517 - protein, 181 aa, Enterobacter
MKTLILFSTRDGQTREIAAYLASELKELGIYSDVVNLNRVEQISWQDYDRVVIGASIRYGHFHPALDRFVKKHTAVLNKLPGAFYSVNLVARKPEKRTPQTNSYTRKFLLSSPWQPELCAVFAGALRYPRYRWYDRFMIRLIMKMTGGETDTRKEVVYTDWSQVASFAREIAHLTDDSRHK

SEQ ID NO: 518 - protein, 181 aa, Enterobacter
MKTLILFSTRDGQTREIAAYLASELKELGIYSDVVNLNRAEQISWQDYDRVVIGASIRYGHFHPALDRFVKKHTAVLNKLPGAFYSVNLVARKPEKRTPQTNSYTRKFLLNSPWQPDLCAVFAGALRYPRYRWYDRFMIRLIMKMTGGETDTRKEVVYTDWSQVASFAREIAHLTGDSRHK

SEQ ID NO: 519 - protein, 181 aa, Enterobacter
MKTLILFSTRDGQTREIAAYLASELKELGIYSDVVNLNRAEQIAWQDYDRVVIGASIRYGHFHPALDRFVKKHAAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 520 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLTGNSRLK

SEQ ID NO: 521 - protein, 181 aa, Enterobacter
MKTLILFSTRDGQTREIAAYLASELKELGIYSDVVNLNRADQITWQDYDRVVIGASIRYGHFHPALDRFVKKHTAKLNTLPGAFYSVNLVARKPEKRTPQTNSYTRKFLLNSPWQPELCAVFAGALRYPRYRWYDRFMIRLIMKMTGGETDTRKEVVYTDWSQVASFAREIAHLTGDSRHK

SEQ ID NO: 522 - protein, 181 aa, Enterobacter
MKTLILFSTRDGQTREIASYLASELKELGIYSDVVNLNRTEQITWQDYDRVVIGASIRYGHFHPALDRFVKKHTAVLNKLPGAFYSVNLVARKAEKRTPQTNSYTRKFLLNSPWRPDLCAVFAGALRYPRYRWYDRFMIRLIMKMTGGETDTRKEVVYTDWSQVASFAREIAHLSRDSQRK

SEQ ID NO: 523 - protein, 181 aa, Enterobacter
MKTLILFSTRDGQTREIAAYLASELKELGIYSDVVNLNRAEQITWQEYDRVVIGASIRYGHFHPALDRFVKKHTAVLNKLPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTDDSRLK

SEQ ID NO: 524 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 525 - protein, 181 aa, Enterobacter
MKTLILFSTRDGQTREIAAYLASELKELGIYSDVVNLNRAEQIAWQDYDRVVIGASIRYGHFHPALDRFVKKHTAILNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 526 - protein, 180 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVTDWSQVATFAREIAHLTGDSRLK

SEQ ID NO: 527 - protein, 181 aa, Enterobacter
MKTLILFSTRDGQTREIASYLASELKELGVYADVVNLNRTEEISWQDYDRVVIGASIRYGHFHPALDSFVKKHTAVLNALPGAFYSVNLVARKAEKRTPQTNSYTRKFLLGSPWQPDLCAVFAGALRYPRYRWYDRFMIRLIMKMTGGETDTRKEVVYTDWAQVASFAREIAQLTADSKVK

SEQ ID NO: 528 - protein, 181 aa, Enterobacter
MKTLILFSTRDGQTREIASYLASELQELGIYSDVVNLNRTEQIAWQDYDRVVIGASIRYGHFHPALDRFVKKHTAALNKLPGAFYSVNLVARKPEKRTPQTNSYTRKFLLNSPWQPDLCAVFAGALRYPRYRWYDRFMIRLIMKMTGGETDTRKEVVYTDWTQVSSFAREIAHLSPESRRI

SEQ ID NO: 529 - protein, 181 aa, Enterobacter
MKTLILFSTRDGQTREIAAYLASELKELGIYSDVVNLNRAEQIAWHDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 530 - protein, 181 aa, Enterobacter
MKTLILFSTRDGQTREIAAYLASELKELGIYSDVVNLNRAEQIAWQDYDRVVIGASIRYGHFHPALDRFVKKHTAKLNALPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRHK

SEQ ID NO: 531 - protein, 181 aa, Enterobacter
MKTLILFSTRDGQTREIASYLASELQELGIYSDVVNLNRTEQIAWQDYDRVVIGASIRYGHFHPALDRFVKKHTAALNKLPGAFYSVNLVARKPEKRTPQTNSYTRKFLLNSPWQPDLCAVFAGALRYPRYRWYDRFMIRLIMKMTGGETDTRKEVVYTDWTQVSSFARDIAHLSPESRRI

SEQ ID NO: 532 - protein, 181 aa, Enterobacter
MKTLILFSTRDGQTREIAAYLASELKELGIYSDVVNLNRAEQIAWQEYDRVVIGASIRYGHFHPALDRFVKKHTAVLNKLPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 533 - protein, 181 aa, Enterobacter
MKTLILFSTRDGQTREIAAYLASELKELGIYSDVVNLNRAEEIAWQEYDRVVIGASIRYGHFHPALDRFVKKHTAVLNTLPGAFYSVNLVARKAEKRTPQTNSYTRKFLLGSPWQPDLCAVFAGALRYPRYRWYDRFMIRLIMKMTGGETDTRKEVVYTDWSQVASFAREIAHLAGDSRLK

SEQ ID NO: 534 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTHKEVVYTDWSQVASFAREIAHLTGDSRLK

SEQ ID NO: 535 - protein, 181 aa, Enterobacter
MKTLILFSTRDGQTREIASYLASELKELGIYSDVVNLNRTEQIAWQDYDRVVIGASIRYGHFHPALDRFVKKHTAVLNKLPGAFYSVNLVARKPEKRTPQTNSYTRKFLLSSPWQPDISAVFAGALRYPRYRWYDRFMIRLIMKMTGGETDTRKEVVYTDWSQVASFAREIAHLSGDSRLK

SEQ ID NO: 536 - protein, 181 aa, Enterobacter
MKTLILFSTRDGQTREIAAYLASELKELGIYSDVVNLNRAEQIAWQEYDRVVIGASIRYGHFHPALDRFVKKHTAVLNKLPGAFYSVNLVARKAEKRTPQTNSYTRKFLLGSPWQPDLCAVFAGALRYPRYRWYDRFMIRLIMKMTGGETDTRKEVVYTDWSQVASFAREIAHLTGDSRLK

SEQ ID NO: 537 - protein, 181 aa, Enterobacter
MKTLILFSTRDGQTREIAAYLASELKELGIYSDVVNLNRAEQITWQEYDRVVIGASIRYGHFHPALVRFVKKHTAVLNKLPGAFYSVNLVARKAEKRTPQTNSYTRKFLLSSPWQPALCAVFAGALRYPRYRWYDRFMIRLIMKMTGGETDTRKEVVYTDWSQVASFAREIAHLTDDSRLK

SEQ ID NO: 538 - protein, 181 aa, Enterobacter
MKTLILFSTRDGQTREIAAYLASELKELGIYSDVVNLNRVGQITWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLSGDSRVK

SEQ ID NO: 539 - protein, 299 aa, Escherichia [sequence omitted]

SEQ ID NO: 540 - protein, 299 aa, Escherichia
MKPDAHQVKQFLLNLQDTICQQLTAVDGAEFVEDSWQREAGGGGRSRVLRNGGVFEQAGVNFSHVHGEAMPASATAHRPELAGRSFEAMGASLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 541 - protein, 299 aa, Shigella
MKPDAHQVKQFLLNLQDTICQQLTAVDGAEFVEDSWQREAGGGGRSRVLRNGGIFEQAGVNFSHVHGEAMPASATAHRPELAGRSFEAMGVSLVVHPHNPYVPTSHANVRFFIAEKPGAEPVWWFGGGFDLTPFYGFEEDAIHWHRTARDLCLPFGEDVYPRYKKWCDDYFYLKHRNEQRGIGGLFFDDLNTPDFDHCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 542 - protein, 299 aa, Citrobacter
MKPDAQRVKQFLLSLQDDICQRLSAVDGAEFIEDSWQREAGGGGRSRVLRNGGIFEQAGVNFSHVHGDAMPASATAHRPELAGRSFEAMGVSLVVHPLNPYIPTSHANVRFFIAEKPGADPVWWFGGGFDLTPYYGIEEDAVHWHRTARDLCQPFGEDVYPRYKKWCDDYFFLKHRNEQRGIGGLFFDDLNTPDFDRCFAFMQAVGKGYTDAYLPIVGRRKTMSWGERERNFQLYRRGRYVEFNLVWDRGTLFGLQTGGRTESILMSMPPLVRWEYDYHPEDGSPEAALSDFIQVRDWV

SEQ ID NO: 543 - protein, 299 aa, Citrobacter
MKPDAQRVKQFLLTLQESICGQLCAVDGAQFVEDSWQREAGGGGRSRVLRNGGVFEQAGVNFSHVHGDAMPASATAHRPELAGRSFEAMGVSLVVHPLNPYIPTSHANVRFFIAEKPGADPVWWFGGGFDLTPYYGFAEDAVHWHRTARDLCLPFGEEVYPRYKKWCDDYFFLKHRNEQRGIGGLFFDDLNTPDFDHCFAFMQAVGKGYTEAYLPIVERRKAMIWGERERNFQLYRRGRYVEFNLVWDRGTLFGLQTGGRTESILMSMPPLVRWEYDWQPEDGSPEAALSEFIKARDWV

SEQ ID NO: 544 - protein, 308 aa, Salmonella
MKPDAHHVKQFLLRLQDDICQTLSAVDGVNFVEDSWRREAGGGGRSRVLRNGGIFEQAGVNFSHVHGDAMPASATAHRPELAGRSFEAMGVSLVVHPHNPYIPTSHANVRFFIAEKPGADPVWWFGGGFDLTPYYGFEEDAVHWHRTARDLCQPFGDDVYPRYKKWCDDYFYLKHRNEQRGVGGLFFDDLNTPDFDHCFAFMQAVGHGYTGAYLPIVERRKAMVWGERERNFQLYRRGRYVEFNLVWDRGTLFGLQTGGRTESILMSMPPLVRWEYGYQPEEGSPEAALCEFIQVRDWVSLPDNSSVS

SEQ ID NO: 545 - protein, 299 aa, Citrobacter
MKPDAQRVKQFLLSLQDNICQQLSAVDGAEFVEDNWQREAGGGGRSRVLRNGGIFEQAGVNFSHVHGEAMPASATAHRPELAGRSFEAMGVSLVVHPQNPYIPTSHANVRFFIAEKPGADPVWWFGGGFDLTPYYGFDEDAVHWHRTARDLCQPFGDDVYPRYKKWCDDYFFLKHRNEQRGIGGLFFDDLNTPDFDHCFAFMQAVGQGYTEAYLPIVERRKAMSWSERERDFQLYRRGRYVEFNLVWDRGTLFGLQTGGRTESILMSMPPLVRWEYDWQPEANSPEAALSEFIQVRDWV

SEQ ID NO: 546 - protein, 299 aa, Rhizobium [sequence omitted]

SEQ ID NO: 547 - protein, 299 aa, Vibrio
MKPDALRVKQFLLNLQDAICQQLTAIDGAEFVEDSWQRDAGGGGRSRVLRNGGIFEQAGVNFSHVHGDAMPASATAHRPELAGRSFEAMGVSLVVHPLNPYIPTSHANVRFFIAEKPDADPVWWFGGGFDLTPYYGFEEDAIHWHRTARDLCQPFGDDVYPRYKKWCDDYFFLKHRNEQRGIGGLFFDDLNTPDFDHCFAFMQAVGEGYTEAYLPIVERRKAMSWGERERNFQLYRRGRYVEFNLVWDRGTLFGLQTGGRTESILMSMPPLVRWEYDWQPDAGSPEAALSDFIQVREWV

SEQ ID NO: 548 - protein, 299 aa, Enterobacter
MKPDAQQVKTFLLALQDSICQQLAAVDGQTFSEDNWQRDGGGGGRSRVLRNGGVFEQAGVNFSHVHGDAMPASATAHRPELAGRSFEAMGVSLVVHPHNPYVPTSHANVRFFIAEKPGADPVWWFGGGFDLTPYYGFEEDAVHWHRTARDLCLPFGEDVYPRYKKWCDDYFYLRHRQEQRGIGGLFFDDLNTPDFDRCFAFMQAVGNGYTDAYLPIVERRKAMAFGERERDFQLYRRGRYVEFNLVWDRGTLFGLQTGGRTESILMSMPPLVRWEYDYQPEDGSPEAALSEFIRVRDWV

SEQ ID NO: 549 - protein, 299 aa, Enterobacter
MTVDANKVKTFLLQLQDDICQQLSALDGGAFIEDSWQRDAGGGGRSRVLRDGGIFEQAGVNFSHVHGDAMPASATAHRPELAGRSFEAMGVSLVVHPRNPYVPTSHANVRFFIAEKPGADPVWWFGGGFDLTPFYGFEEDAIHWHRTARDLCQPFGEDVYPRYKKWCDDYFFIKHRNEQRGIGGLFFDDLNTPDFDSCFAFMQAVGNGFTDAYLPIVKRRKAAIWGERERNFQLYRRGRYVEFNLVWDRGTLFGLQTGGRTESILMSMPPLVRWEYDYQPQAGSPEAALSEFIKVRDWV

SEQ ID NO: 550 - protein, 299 aa, Enterobacter
MKPDVQQVKAFLLQLQDAICAKLSAVDGKDFVEDSWQREGGGSGRSRVLRDGGIFEQAGVNFSHVHGDAMPASATAHRPELAGRSFEAMGVSLVVHPRNPYVPTSHANVRFFIAEKPGADPVWWFGGGFDLTPYYGFEEDAIHWHRTARDLCLPYGDEVYPRYKKWCDDYFFLKHRNEQRGIGGLFFDDLNTPDFDHCFAFMQAVGNGFTDAYLPIVERRKTTPYGERERDFQLYRRGRYVEFNLVWDRGTLFGLQTGGRTESILMSMPPLVRWEYDYHPQEGSPEAALSEFIKVKEWI

SEQ ID NO: 551 - protein, 300 aa, Kluyvera
MTINVQQVKAFLLKLQDDICQQLERVDGGTFIEDSWQREAGGGGRSRVLRDGSVFEQAGVNFSHVHGDAMPASATAHRPELAGRSFEAMGVSLVVHPRNPYVPTSHANVRFFIAEKPGAEPVWWFGGGFDLTPYYGFQEDAVHWHTVARDLCLPFGEDVYPRYKKWCDDYFHLKHRNEQRGIGGLFFDDLNTPDFDHCFGFMQAVGKGFTDAYLPIVERRKAMAYGERERDFQLYRRGRYVEFNLVWDRGTLFGLQTGGRTESILMSMPPLVRWEYNYQPEEGSPEAALSEFIKVKDWLL

SEQ ID NO: 552 - protein, 299 aa, Trabulsiella
MKPDAQQVKTVLLTLQDTLCQQLSATDGSGFTEDLWQRAAGGGGRSRVLRNGGVFEQAGVNFSHVHGDAMPASATAHRPELVGRSFEAMGVSLVIHPHNPYVPTSHANVRFFIAEKPGADPVWWFGGGFDLTPFYGFNEDAVHWHTTARDLCLPFGDEVYPRYKKWCDDYFWLKHRNEQRGIGGLFFDDLNTPDFDHCFAFMQAVGNGFTDAYLPIVERRKMMPFGEREREFQLYRRGRYVEFNLVWDRGTLFGLQTGGRTESILMSMPPLVRWEYNYEPEKGSPEAALSEFLQVRDWI

SEQ ID NO: 553 - protein, 299 aa, Raoultella
MKPDAHQVKRYLLQLQETICQKLSAIDGGEFVEDSWQREGGGGGRSRVLRDGGVFEQAGVNFSHVHGDAMPASATAHRPELAGRSFEAMGVSLVVHPWNPYVPTSHANVRFFIAEKPGAEPVWWFGGGFDLTPFYGFEEDAVHWHRTAHDLCQPFGEEVYPRYKKWCDDYFYLKHRHEQRGIGGLFFDDLNTPDFDHAFAFMQAVGNGYTDAYLPIVEQRKAMPYGERERNFQLYRRGRYVEFNLVWDRGTLFGLQTGGRTESILMSMPPLVRWEYDYQPEEGSPEAALSEFIQVREWI

SEQ ID NO: 554 - protein, 299 aa, Kosakonia
MTPEIAPVKNALLALQDKICRQLSDIDGATFVEDAWQRAEGGGGRSRVLRDGGVFEQAGVNFSHVHGDAMPASATAHRPELAGRSFEAMGVSLVVHPRNPYVPTSHANVRFFIAQKPGADPVWWFGGGFDLTPYYGFEEDAIHWHRTARDICLPFGEEIYPRYKKWCDDYFYLKHRNEQRGIGGLFFDDLNTPDFDHCFAFMQAVGNGYLDAYLPIVARRKALPYGERERDFQLYRRGRYVEFNLVWDRGTLFGLQTGGRTESILMSMPPLVRWEYNYQPAEGSPEAALSEFIQVKDWV

SEQ ID NO: 555 - protein, 299 aa, Enterococcus
MKPDAAQVKTFLLQLQDNLCQQLSAVDGAPFIEDAWQREGGGGGRSRVLREGRVFEQAGVNFSHVHGDAMPASATAHRPELAGRSFEAMGVSLVVHPLNPYVPTSHANVRFFIAEKPGADPVWWFGGGFDLTPYYGFEEDAVHWHRTARDLCLPFGEEVYPRYKKWCDDYFYLKHRQEQRGIGGLFFDDLNTPDFDHCFAFMQAVGNGYADAYLPIVERRKATPYGERERHFQLYRRGRYVEFNLVWDRGTLFGLQTGGRTESILMSMPPLVRWEYDYQPEPGSPEAALSEFIQVRDWL

SEQ ID NO: 556 - protein, 307 aa, Unknown
  gamma proteobacterium
MNQLPDINQVKAFLLSLQDQICQKLSAVDGRAQFKQDQWVREEGGGGQSRVLTGGAIFEQAGVNFSHVSGATLPASATAHRPELAGRSFQAMGVSLVIHPLSPYIPTSHANVRFFIAEKPGEAPVWWFGGGFDLTPYYGFEEDARHWHQTAADLCQPFGDDVYPKYKKWCDDYFFIKHRNEARGIGGLFFDDLNSPDFAHCFAFMQAVANGFTDAYLPIVERRKTLTWGEREREFQLYRRGRYVEFNLVWDRGTLFGLQTGGRTESILMSMPPLVRWEYGFEPDENSPEAALYRDFLPVRDWLAESE

SEQ ID NO: 557 - protein, 303 aa, Shewanella
MKPDATQVKAFLLDLQQRICEGLEQLDGEAKFVADSWEREEGGGGTSRVLTKGKVFEQAGVNFSHVTGAAMPASATAHRPELAGRSFEAMGVSLVIHPNNPYVPTTHANVRFFIAEKEGADPVWWFGGGFDLTPYYPFEEDVVAWHQSAKALCEPFGEDVYPKYKKWCDEYFFLPHRNETRGVGGLFFDDLNEPGFENSFAFMQAVGEGFLKAYAPIVEKRKETAYGERERDFQLYRRGRYVEFNLVYDRGTLFGLQTGGRTESILMSMPPLVRWQYAYTPEAGSPEAKLYSDFLKPREWLEA

SEQ ID NO: 558 - protein, 302 aa, Oceanimonas
MSSKPDTSAVKAFLLALQDNICRQLEQADGSGRFIEDSWTREEGGGGRSRVLRNGTVIEQGGVNFSHVYGAAMPASATAHRPELAGRSFEAMGVSLVIHPHNPHVPTSHANVRFFIAEKEGAEPVWWFGGGFDLTPFYPVEEDCRHWHQVSKDLCEPFGEDVYPKYKEWCDRYFYLKHRNETRGVGGLFFDDLNEWPFERCFAFMKAVGEGYLDAYLPIIARRKDTPYGEDERQFQLYRRGRYVEFNLVYDRGTLFGLQTGGRTESILMSMPPLARWEYDWQPEAGSREARLQAFLVPRSWV

SEQ ID NO: 559 - protein, 302 aa, Chromobacterium
MSHPHSDAVKAILLDLQDRICAALEGADGDGRFVEDAWQREAGGGGRSRVLSNGAVFEQAGVNFSHVHGDALPASATAHRPELAGRRFEAMGVSLVIHPHNPHVPTSHANVRFFIAEKAGEAPVWWFGGGFDLTPFYPVREDVVHWHTVARDLCAPFGPEVYPRYKKWCDEYFYLKHRNEARGVGGLFFDDLNEWGFDQSFAFMQAVGNGYLDAYLPIVQARKDTAWGARERQFQLYRRGRYVEFNLVWDRGTLFGLQSGGRTESILMSMPPLVRWEYGYQPEPGSAEALLYTDFLPPRDWV

SEQ ID NO: 560 - protein, 302 aa, Pseudogulbenkiania
MSHPHSDAVKSFLLDLQDRICAALEQADGKAQFAEDAWSREAGGGGRSRVLAGGGVFEQAGVNFSHVHGDALPASATAHRPELADRRFEAMGVSLVIHPSNPHVPTSHANVRFFIAEKDGEAPVWWFGGGFDLTPYYPQEEDAVHWHTVARDLCAPFGGEVYPRYKKWCDEYFHLKHRNEARGIGGLFFDDLNEWGFDKSFAFTRAVGDGYLDAYLPIVARRKEQAWGDRERQFQLYRRGRYVEFNLVWDRGTLFGLQSGGRTESILMSMPPLVRWEYGYQPEPGSPEARLYTDFLPPRDWV

SEQ ID NO: 561 - protein, 302 aa, Chromobacterium
MSHPHSNAVKSFLLDLQDRICAALEQADGKAQFAEDAWSREAGGGGRSRVLTGGEVFEQAGVNFSHVHGDALPPSASAHRPELAGRRFEAMGVSLVIHPSNPHVPTSHANVRFFIAEKDGEAPVWWFGGGFDLTPFYPQEEDAVHWHTVARDLCAPFGGDVYPRYKKWCDEYFHLKHRNEARGIGGLFFDDLNEWGFDKSFAFTRAVGDGYLDAYLPIVARRKEQAWGDRERQFQLYRRGRYVEFNLVWDRGTLFGLQSGGRTESILMSMPPLVRWEYGYQPEPGSPEARLYTDFLPPRDWV

SEQ ID NO: 562 - protein, 302 aa, Aeromonas
MSKPDVAQVKAFLLQLQDEICRGLELADGVGHFVEDAWLREGGGGGRTRVLRHGAVIEQGGVNFSHVHGDAMPASATAHRPELAGRRFEAMGVSLVIHPHNPYVPTSHANVRFFIAEKEGEEPIWWFGGGFDLTPFYPFEEDVRHWHQVSRDLCQPFGTDIYPEFKSWCDRYFFLKHRDETRGVGGLFFDDLNRWPFADCFAFMQVVGKGYLDAYLPIVERRKALAYGEREREFQLYRRGRYVEFNLVYDRGTLFGLQTGGRTESILMSMPPLARWEYDWQPPAGSPEALLYSDYLKPREWL

SEQ ID NO: 563 - protein, 310 aa, Glaciecola
MNTELPSHEKIAQVKAFLLKLQDNICQTLELSDGKARFVEDEWEREQGGGGRTRVLTNGAVIEQGGVNFSHVFGDQMPASATAARPELAGRRFQAMGVSLVIHPHNPYIPTSHANVRFFIAEKEGEAPIWWFGGGFDLTPFFPFKEDVVHWHKVAHDLCLPFGEDVYPKYKKWCDDYFYLKHRNETRGVGGLFFDDLNTPDFETAFGFMQAVGNGYLDAYVPIIEKRKNTEYGNMERDFQLYRRGRYVEFNLVYDRGTLFGLQTGGRTESILMSMPPLVRWEYNYVPDEHSAQGKLAAYLTPQDWLAGQS

SEQ ID NO: 564 - protein, 304 aa, Alteromonas
MDGKNAAEVIEQVKSYLLGLQDTICQTLELADGKGQFVEDSWQREEGGGGRSRVLKNGAVIEQGGVNFSHVFGSQMPASATANRPELAGRNFQAMGVSLVIHPHNPYIPTSHANVRFFIAEKEGEAPIWWFGGGFDLTPFYPFKDDVVHWHDTAKKLCKPFGEDVYPKYKKWCDEYFYLKHRNETRGVGGLFFDDLNEWGFEQSFAFMQAVGNGFIDAYVPIVERRKQTDYGERERDFQLYRRGRYVEFNLVFDRGTLFGLQTGGRTESILMSMPPLARWEYCYTPAPGSAEAKLTDWLKPTPW

SEQ ID NO: 565 - protein, 305 aa, Gilvimarinus
MTTTPDKHAVKAYLMDLQERICDSLAAVDGGRFAEDTWQRAEGGGGRSRVLADGAVIEKGGVNFSHVMGDAMPASATAHRPELAGRSFEAMGVSLVIHPANPYAPTSHANVRFFIAEKEGADPVWWFGGGYDLTPFYGFVEDCVHWHKTAFEACAPFGDDVYPRYKNWCDEYFYLKHRNEARGVGGLFFDDLNELGFDQSFAFMRAVGDSYLQAYRPILERRKDSPYGEREREFQLYRRGRYVEFNLVYDRGTLFGLQTGGRTESILMSLPPLVRWEYDFHPEPDSPEARLSRDFLPHQDWLARQ

SEQ ID NO: 566 - DNA, 453 bp, Acinetobacter
atggatgcaccttctgatgctttcttatgggtaaaagcattacatattattgccgtagtatgttggtttgctgccttattctatttacctcgactctatgtttaccatgccatgagtgaggatgacactagtcatcgtcgttttgaagtcatggagcgtaaactttatcgtgggattatgtggccttctatgattgcgacactgatcactgctcattttttggtagattggggcgatgcaacacgacattatcatgaagcactctggttttatatcaaagtcggattggtgggacttttagttatctatcattttgtttgcggctactaccgtaaaaaactgattggcaatgcccattataaatcacacaaattctggcgttattttaatgaaatgccgacactgattttatttgcagtcgtgatcctggtcgtggtcaaaccacaattttaa

SEQ ID NO: 567 - DNA, 1365 bp, Calditerrivibrio
ttatttgtttaagagatttttaaatctatccacattcataaagcttgttctggtgcaatcatttatacccacaccatataagatattaccaccgataaaaatgtcatcaaattttttatagaactcttcaaccttttcaactattttgtggtgcccgatgtagtactgggggattgctttttcccatctaaaatattttattttgtaaggctctctttttatttttaaagtttcttttatgtcatcgaaagccatcctgataagttcatcgtcggatttttcaattatccatctatttttatctccacccattatcgttctaacgattttgtatccatcccttgttctatcagggaatatcgaagaatcaaacagtgctcccaaaattcttttattctctgaatggggtatcagatagccgaagccatccagaggatcttccagatcctccggcttgaatataaacccagcaacaaaaacaggagggtaagtgatgttatttagatccctggatagatctttatcaagaactgagagcatttgggaaacagcataggccggggcatttatgaatattttatcgaactccatgatgcctttattggtatttaatatatatctgtttatttttttatctattgaaaatacttccgtattcaacatctttgtgatgcttgtggattcgagtaaatctgttatcatattatccagtccatttttgtatgaagtaaggattccgccggggcctgatgggccactttttttcccttttttctttatcatccctttaaaaaggccaccataatttatttccagatcccttattacggggaaacaggatcttaagctcatcttttcgggatcacctgcaaaaatgccagagaccattgggctgataaggtattcaagagcttctttccccaatcttcttctggcaaagtctgccacagattcatcttcaaggacacttttttgtatgaaatattcggatagtatcctcatttttgctgagaaggagagtagcttagttttgaaaaacattggtggattttcaggtaatctatgtaaaatcccattgcgcatgatatatctttttcttgctaagtcattacttttgacaagattgttgcttaatcctgccattgatagaagttcaagggtatggggtttgctgtctaaaaaaccatttggccctgcttctactatgaacccatcttcccgtgaggtctctattgaaccgccccacctcaatctcttttctatgattgttatttccatatccagattcagttcatttttcaaattttccaataaaaaagcggtggatatccctgatattccgcctcctattatggctactctcat

SEQ ID NO: 568 - DNA, 1488 bp, Candidatus
atggcgacggaacagcacagcggcagcaggcgtatcgtggtggtggggagcggcatcgcgggtctggctgccgcctatcggctgcaggagcggtgcgagcaggacggcccgccttgcgaggtgcgcgtattggaggccgctgcacggcccggcggtgcgatcagtaccacgcaccgggatggttttgttcttgaatctgggcccgataccattttcaccgataagccgtggggattggatctgatcagacgcctcggtctgagcgagcaggtcatcgggaccaatgaggcgcaccgccggacctttgttgtgcgggacggcgcactgcacccgctgcccgaagggttcgccttgatggggccgaccaagccttggccgtttctgcaatcagggctgctgtcatggcgcggcaaggcaagggcggctctggacctggtactgccgcgagggggaccatccgacgacgagagcctggcgtcgttcgttcggcgtcgtttcggacaggagtttctcgatcggctggcccaaccgatgatcggtggaatctatggcgccgacccggagcggttgagtctgcgcgctaccttcccgcagtttctgcagatggaagcgacgcatcgcagcgtgatcctcggcctgcgacgaatgcgccccgccggccgcggcgtaggtcataccagcagcggcccgcgctatggcctgtttgtcacgctggatcacgggctgcaggccctcgtcgatgccatggtaaaaaggctgccggctgggacgctgcgtctccgcgcgccggttgatagaatcgcgcacacagagcaaggctggaccgttcgacttggagacggcgcgagcctgcaggccgatggccttattctcgccgtccccgcatttgagattgccaggcttacccacgacctggaccaagacctggctcgtcagctcgaggccatgccctacgcctcttcggtcacgatcaatctggcctatcgtagagaggcgatccaccatccgctcgacgggtttggatttgtggtgccggcctgcgaggggcgcaccatcattgcctgttcgttcagcagcgtgaagttcgctcatcgggcgccggccggtcacgtcctgctgcgtgccttcgcgggcggcgcgctgcagccggagccgttcacctgggatgacgagacgctgctgagcgcagtgcgccgcgatctggaggagctgctggcgattcacgcgccgcctttgtggagccagttggtccgacatcctcgtgtgatgccccagtaccaggtcggccacctgggccggttggcggcgctcgaagagacgcttcggcggtggccgaccctcaagctgaccggtaacgcctacagaggtgtcggtgtgccggatgtggttcacagcggggagacggccgccgattcattattggcagagctggccccgtcaccgaccgagccgacccccgcttgtaccgaaggcgattctcgcctataa

SEQ ID NO: 569 - DNA, 1425 bp, Chloroflexus
atgatggcgggatacgacagtgtagtgattggcggtggcattgccggtttagctgcggcttacacgctccacaagcgtggttatcgggtcctggtcatcgagtcgaccaatcgcgttggcggtgtgatccagaccatcaccacaccagaaggctacattctcgattgtgggccgaacacggtgggtaccggcgatgcgcgattgtggcaggaactgatcgatctgggtctgcgcgagcggatcacaccggcagcgccatgtagcaaacggcggttcatcctgatcaatggtacaccggttgaaatcccaacctcaccagtcgggctgattaccacgcgattactctcgtggcgggggaaattgcgggtactggccgaaccgttcatcaaccgtggatcgaccgatcccgatgaaagcgttgctgccttcttcacccgccggattggtgcagaggctaccgcccacctcctcgatccatttgttgccggcgtctacgctggcgatccgcaacggctctcgactgcggcagtctttccatcactgtgggaagcggcccagcgcagtggcagcatcgtgcgcggcatgctgagcaaacccaaaccgaagactcaggtgagtgagccaaagatgcgcagccgcacctttaccttccgcggtggcctggccgaatggccacgcgctctggcgcaagccctgggtgccggcaatgtctggacagaacggcgcgtggtcaagctccaaccacgcgactcctggtgggaagtgacgattgatggtgtgaacggcccggagacactcatcagtcgcagcctcattatcgccaccccagcctttacggcggctgatctcattgagtcggttgatcaaagagcggctggtgccctacgcggcattccgtatgcgccggtagcagtggtacatctcggctttcgtcgtgaccagatcagccaggaattgagcggctttggtgtgctggccccctcaagcgaacagcgtcagttcctcggcattctctggacatcaagcatcttcccgcacgttgcaccacacgatcatgtcctcaccacaaccctcagtggtggtgctatccggcccgaactggccgaacggagtgacgaaacactgattgaagcggccattcgcgatcatcaccagctcctggggatcagagggcaaccgatcttcacccatgttactcgctggcgaaccgccattgcccagtatacctttgggcaccgcgagcggattgccaccctcgtgcaactcgaacagcgcctgccgaccatccagtttgccggcagctaccgcgacggcgttggagtgcccaaaacctgggccagcggtgtgcaggcaggcgagcggatcgctgcggcactggcagcccatggaactaccgcagtttccacagagacggcgtcggggtga

SEQ ID NO: 570 - DNA, 546 bp, Escherichia
gtgaaaacattaattcttttctcaacaagggacggacaaacgcgcgagattgcctcctacctggcttcggaactgaaagaactggggatccaggcggatgtcgccaatgtgcaccgcattgaagaaccacagtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataa

SEQ ID NO: 571 - DNA, 900 bp, Escherichia
atgaaacccgacgcacaccaggttaaacagtttctgctcaaccttcaggatacgatttgtcagcagctgaccgccgtcgatggcgcagaatttgtcgaagatagttggcagcgcgaagctggcggcggcgggcgtagtcgggtgttgcgtaatggtggtgttttcgaacaggcaggcgtcaacttttcgcatgtccacggtgaggcgatgcctgcttccgccaccgctcatcgcccggaacttgccgggcgcagtttcgaggcgatgggcgtttcactggtagtgcatccgcataacccgtatgttcccaccagccacgcgaatgtgcggttttttattgccgaaaaaccgggtgccgatcccgtctggtggtttggcggtggcttcgacttaaccccattctatggttttgaagaagatgctattcactggcatcgcaccgcccgtgacctgtgcctgccatttggcgaagacgtttatccccgttacaaaaagtggtgcgacgaatacttctacctcaaacatcgcaacgaacagcgcggtattggcgggctgttctttgatgacctgaacacgccagatttcgaccgctgttttgcctttatgcaggcggtaggcaaaggctacaccgacgcttatttaccaattgtcgagcgacggaaagcgatggcctacggcgagcgcgagcgcaatttccagttatatcgtcgcggtcgttatgtcgagttcaatctggtctgggatcgcggcacgctgtttggcctgcaaactggcgggcgcaccgagtctatcctgatgtcaatgccgccactggtacgctgggaatatgattatcagccaaaagatggcagcccagaagcggcgttaagtgagtttattaaggtcagggattgggtgtaa

SEQ ID NO: 572 - DNA, 1326 bp, Hydrogenobacter
atgatagatgtagcggtagtaggggcaggtatatccgggctatccatagcctatcaccttaaaaaggctggacttgaggtaaaggtttttgaaaaagaagatgccgtaggtggaaacatacaaacagcatacatagacggttatgtttgcgagcttggacctcagaccattcttgcggacagtaaagtagaagagtttttaaaagatgcaggtataaagcccatatatgccaatccttcttccaaaaagagatacatatacaggaagggtaagttggtggctcttcctctatcacccgtagaatttctcttatcaccttttctgtccctcggcggaaagctaagagtcctcaaagagccttttgttccaaggtctcccaagcaggaagaaagtatagcggagtttgtcagaaggcgttttgggagggagtttttagattatgtagtagctcctttcgtgtctggagtttacgctggagacccagaggagctatctgttaaatacgcagttagaaaggtttacgagctggagcaaaagtacggaagcgttataaagggagccataaagctcaaagctcttggtccatcgggaaagctcatatcctttgaaggaggaaatgcaactcttataagaaagctctctgaaagtttagaggttcataaagagaatgtggttctgaggataaggagaaaggacgatatttttatcctagataccaaggaggggaaggttacggctaaggcggttgtagtttctactcctgccacatctacaggttatctgctcagggatctgtcttggagcatatccgaggagtttgacaaaatatactacgctcctgttctggtggtgcatgtggcagtaaagtttggtgttctgccagaaggctttggttttttagtgccaaaaaaggaaaacaaaaggatactgggggtgatcttttcatctaatctttttgaaggaaggagtccagagggcaagagtcttatcaccgtatatattggtggtgccacagacccagaaataatagaatacgaagatgaagccattgtaagtgtgctggagagggaactaagagagaccgtagatataagagactgggatcttttaaaaataacgcgctggaaaaagggtataccccaatacactgtggggtacggaaggtatcttgagctggcaaactccatagagatggagcaacccggacttttcttgagtggcaattatctttatggtgtttccgttgcagactgtataagagtttcacatcacatagcaaagagggtaatagactttttggaagttaaggggcgtactgttgtataa

SEQ ID NO: 573 - DNA, 1323 bp, Laribacter
tcagctggccggcgggtagtccagcaagcactggacagccacctgctgccccttgtcgagacagtcgacgaccgataccccgccatgccagttggcacacacgcggataccgtgttcatgcaggtcactgaccgcgctggccagcggcagggcatggctgtcgtactgcggaatggcctgctcctgacgggtcagccggcaaagggtcggctcgccctggatgcggtagagccgccgcagttcttccagcgccagcgccaccagcgtggcgtcatcgtgccggtaacggtcaaggaactgcatgccgccgacaaaggtggtcagcagggtttcgcctgccggcgtgcggtcgggaaacagcgagccggaccagatggagccggcggcaaacggtttttcgactttggggttcagcccgccaaaaccgtcgaggtcatgcccgaccgtgctgcgtggccaggccgtatgcaggacggccaccggggcgtaggttacgttggcaaggttcgctgcaatggccggaaaatggctggccagcagttgcccggccacgtcggccggcacggccagcaccacttcgtcggcgtccagttcacctgctggggttctgacccgccagccggtttccagccgctccagtgcctgcaccgacgtatccagccgtacgtccagcccctgcgccagcgtttcgggcagctgctgcaaaccctcgttcagggtgaaggtggccttgcgccggaaggttttgcggcgggcaaacatgccgcgcacgatggagcctgactggcgctcggcttcgtggatgaccggcagcgtcagtccggccaccagctcttcgggatcaccggcaaaaatgccgccgacaaacggcgaaatggcccgctcgacaaattcgtcgcccagacgacgccggaaaaaggcagccacggtttccggctcacgcaccggccggttgcgccggaaaggctcggtcagcgccagccatttgctccgggcaccgaactgcgatccggtcaggaacgacagcggtccggacggcagggcctcgtagcgatcgccgcgcagcacgaaacggtgccggaccacggccgccgccggccggatggctgccgtgaggcccagccgttccagaaggtccagatgcccggcatggccgtaaagggtattggggccgagttccagccggtaaccgtcggccgctaccgtcccgatcttgccgccgacccggctgccggcctccagcaccacgacggggatgccccgctgttgcaggtgccaggcacacgacaggccggaaatgccggcaccgatcaccaccaccat

SEQ ID NO: 574 - DNA, 1404 bp, Opitutus
ctattgcccggcgcgttccgccagtttttcgccggccgcgatgcaggccgggacggcgatcccgtcgcgggcctgtccccccatgaacagtcccggatggaagcgttcgccggcggcaagagcggcgatgaagtgctcgtgaccgaggttgtactgcgggatggcgcgaggccagaagttgtgccggacaaaaaccgggtcgccgctgacgccgagcaactgcgtgagatcgggccgcacggcggcaagcagctgatcggcgggcaggctggcgagttgcggctggcgtgttccgcccaccatcaccgtcagcgccacgtgtcccagcggcgcgcggcccgggaacagcgaggacgagaacagcacgccaaggaccgagcgcttctcgacggccggcacgagcacgccgaacccgtcgagcggatgcgcgacctgctcgcggcggaagccgaggaagagcgacgagaccggcgggtgttcgatcagcgccagcgcggcgagcggcttttcgccgagcgtgccgatctggagtcgcgcgagggcgggcgcgggcagcgcgaccacgacgctgtcgaagctttgcgtgtgcgtcgccacgtcgtcgtgccaaaccacgttccacttgtcgccgggcacgatggcgtcgagcgaagcgccgagtgtgatggcgccggcggggagacgcgcggcgagcgcctccggcagcacgtgcaggccgtgtttgaaggaaaagatgccggggcgcggctcaccgcgggccttccgggctttggccgcggcgatctggccgcggatcagcgagccgtgggtttgttcgatttcccagagcttggggaacgactgccgcgcggagagcttttcgggatcgccggcatacacgccgcccacgaacggattgagcgcgtagtcgacgaactcgcgcccgaagtgcgactcgacgaattcggcgaggctgacgtcggtcgtgcggacgcgccgccgggcgaacagctcggcgaggagcttgaacttggcgacgggcgaaaacagtgaggaggcgaagaacgacggtggggacatcggcgcggccagcgcgcggccgcggcgaacgatgtagcggtttttcgcggcgggatccgcggcgatgcgttcgccgttcagcccgagttcgtcgatgagcttgtcgacggcgagttcgccggagagcagcgtgttgggtccgccttcgatcagccagccgtcgacttcctccgtcttgatcgagccgccgacgcggtcggattgctcgaacacgcgcaccttgtggccgagctgggtgagccggtgggcggcggtgagcccggtgatgccggcgccaagcacggcgaacgttttgggcggccggcctgaggcggtggcggaaggattaaaaggcgaggtgctcat

SEQ ID NO: 575 - DNA, 1410 bp, Rhodothermus
atggcttctgtgggaatcatcggagccggcattgccggtctgacggccgcctacgaactgcaccgtcgtggcctggaagtgacggtctttgaagccaccgaccgcatcggcggcttcattcagtcggagcggatcgacggctttctggtggagctcggtcctcagacgctccagcgcacctcgggcgacttcgaagagttgctgcgacaggtggatctggaggacgcgtgcattccggcccgaccggtcgcggcgaatcgcttcatcgtgcggggtggccagccgatacccctgccacgctcgccgcgcgaactgctgcgcacgccgctgctttcgccccgggcgcgcctgcgcctgctggccgagccgttcattcaccgggcccaccggagcaccgaggaaagcgtggccaaattcacccggcgtcgactgggtccggaggtgctcgactatctggtagagcccttcgtggccggcatctttgcgggcgatcccgagcagctttcggtgcgctacgccttcccgaaactgttcgaactggagcagcagtacggctcgcttttctggggcctgatccgcgatcggatgaagcagcggtatcatccggccccgcgccgctcgatgttctcgtttgtcgagggcctgcacatgctgccccgggcgctggccgagcggttgcccgcgcacgcgatcgtgcgcaacgcggaggtgctggccatccgctgggacgagaaaaacccctggacgctcacgttccggcagcacggccgcgcttcgacccgttttttcgatatcatcgtctgtgccgtgccgctacaccggctggcgcaactccggattcatcccccggtggatcgccggccgctcagcaccgtcgagcacccgcccattgcgctggtggcgctgggcttccggcgcgagcaggtggcccatccgctggacggcttcgggatgctggtaccggccgtggagcgcgactttcagattctgggcacgctgttctcctcgtcgctctttccggaccgggcgcccgaaggccacgtgctgctgaccacgttcgtcggcggcatgcggcatcccgaactggcgttgctgcccgaagatcggctggaggcgctggtgctgcaggacctgcgccggctgctgggcatctcgggcgcgccggtcttccggcacgtgtggcgctgggagcgctcgatcccgcagtaccggctgggctacgatgcggtgctcgcctgcgttcacgatgtggaaatgagccgctccggtctgtttctggccggcaactacatggaaggcatctccgtgatcgacgcgctccataccggcctgaaggccgcccgcgcgatcatccagcacctgcgcgaagaagcagccggcggtctggccaagctggtgctgggagattga

SEQ ID NO: 576 - skipped

SEQ ID NO: 577 - protein, 534 aa, Amaranthus tuberculatus; identical to SEQ ID NO: 1

SEQ ID NO: 578 - skipped

SEQ ID NO: 579 - protein, 534 aa, Amaranthus tuberculatus; identical to SEQ ID NO: 2

SEQ ID NO: 580 - skipped

SEQ ID NO: 581 - protein, 533 aa, Amaranthus tuberculatus; identical to SEQ ID NO: 3

SEQ ID NO: 582 - skipped

SEQ ID NO: 583 - protein, 533 aa, Amaranthus tuberculatus; identical to SEQ ID NO: 4

SEQ ID NO: 584 - skipped

SEQ ID NO: 585 - protein, 547 aa, Arabidopsis thaliana; identical to SEQ ID NO: 25

SEQ ID NO: 586 - skipped

SEQ ID NO: 587 - protein, 548 aa, Nicotiana tabacum
MTTTPIANHPNIFTHQSSSSPLAFLNRTSFIPFSSISKRNSVNCNGWRTRCSVAKDYTVPSSAVDGGPAAELDCVIVGAGISGLCIAQVMSANYPNLMVTEARDRAGGNITTVERDGYLWEEGPNSFQPSDPMLTMAVDCGLKDDLVLGDPNAPRFVLWKGKLRPVPSKLTDLPFFDLMSIPGKLRAGFGAIGLRPSPPGHEESVEQFVRRNLGGEVFERLIEPFCSGVYAGDPSKLSMKAAFGKVWKLEETGGSIIGGTFKAIKERSSTPKAPRDPRLPKPKGQTVGSFRKGLRMLPDAISARLGSKLKLSWKLSSITKSEKGGYHLTYETPEGVVSLQSRSIVMTVPSYVASNILRPLSVAAADALSNFYYPPVGAVTISYPQEAIRDERLVDGELKGFGQLHPRTQGVETLGTIYSSSLFPNRAPKGRVLLLNYIGGAKNPEILSKTESQLVEVVDRDLRKMLIKPKAQDPLVVGVRVWPQAIPQFLVGHLDTLSTAKAAMNDNGLEGLFLGGNYVSGVALGRCVEGAYEVASEVTGFLSRYAYK

SEQ ID NO: 588 - skipped

SEQ ID NO: 589 - protein, 555 aa, Cichorium
MTSLTDVCSLNCCRSWSSLPPPVSGGSLTSKNPRYLITYSPAHRKCNRWRFRCSIAKDSPITPPISNEFNSQPLLDCVIVGAGISGLCIAQALATKHASVSPDVIVTEARDRVGGNISTVERDGYLWEEGPNSFQPSDAMLTMVVDSGLKDDLVLGDPTAPRFVLWGGDLKPVPSKPADLPFFDLMSFPGKLRAGFGALGFRPSPPDREESVEEFVRRNLGDEVFERLIEPFCSGVYAGDPSKLSMKAAFGKVWNLEQNGGSIVGGAFKAIQDRKNSQKPPRDPRLPKPKGQTVGSFRKGQAMLPNAISTRLGSRVKLCWKLTSISKLENRGYNLTYETPQGFESLQTKTIVMTVPSYVASDLLRPLSLGAADALSKFYYPPVAAVSISYPKDAIRADRLIDGQLKGFGQLHPRSQGVETLGTIYSSSLFPNRAPPGRVLLLNYIGGATNPEILSKTEGEIVDAVDRDLRTMLIRRDAEDPLTLGVRVWPRAIPQFLIGHYDILDSAKAALSSGGFQGMFLGGNYVSGVALGKCVEAAYDVAAEVMNFLSQGVYK

SEQ ID NO: 590 - skipped

SEQ ID NO: 591 - protein, 562 aa, Spinacia
MSAMALSSTMALSLPQSSMSLSHCRHNRITILIPSSSLRRRGGSSIRCSTISTSNSAAAANYQNKNIGTNGVDGGGGGGGVLDCVIVGGGISGLCIAQALSTKYSNLSTNFIVTEAKDRVGGNITTMEADGYLWEEGPNSFQPSDAVLTMAVDSGLKEELVLGDPNSPRFVLWNGKLRPVPSKLTDLPFFDLMSFPGKIRAGLGALGLRPSPPAHEESVEQFVRRNLGDEVFERLIEPFCSGVYAGDPSKLSMKAAFGRVWVLEQKGGSIIGGTLKTIQERKDNPKPPRDPRLPKPKGQTVGSFRKGLSMLPTAISERLGNKVKVSWTLSGIAKSSNGEYNLTYETPDGLVSVRTKSVVMTVPSYVASSLLRPLSDVAAESLSKFHYPPVAAVSLSYPKEAIRSECLIDGELKGFGQLHSRSQGVETLGTIYSSSLFPGRAPPGRTLILNYIGGDTNPGILDKTKDELAEAVDRDLRRILINPNAKAPRVLGVRVWPQAIPQFLIGHFDLLDAAKAALTDGGHKGLFLGGNYVSGVALGRCIEGAYESAAEVVDFLSQYSDK

SEQ ID NO: 592 - skipped

SEQ ID NO: 593 - protein, 531 aa, Spinacia; identical to SEQ ID NO: 7

SEQ ID NO: 594 - skipped

SEQ ID NO: 595 - protein, 557 aa, Solanum tuberosum
MTTTAVANHPSIFTHRSPLPSPSSSSSSPSFLFLNRTNFIPYFSTSKRNSVNCNGWRTRCSVAKDYTVPPSEVDGNQFPELDCVVVGAGISGLCIAKVISANYPNLMVTEARDRAGGNITTVERDGYLWEEGPNSFQPSDPMLTMAVDCGLKDDLVLGDPDAPRFVLWKDKLRPVPGKLTDLPFFDLMSIPGKLRAGFGAIGLRPSPPGYEESVEQFVRRNLGAEVFERLIEPFCSGVYAGDPSKLIMKAAFGKVWKLEQTGGSIIGGTFKAIKERSSNPKPPRDPRLPTPKGQTVGSFRKGLRMLPDAICERLGSKVKLSWKLSSITKSEKGGYLLTYETPEGVVSLRSRSIVMTVPSYVASNILRPLSVAAADALSSFYYPPVAAVTISYPQEAIRDERLVDGELKGFGQLHPRSQGVETLGTIYSSSLFPNRAPNGRVLLLNYIGGATNTEIVSKTESQLVEAVDRDLRKMLIKPKAQDPFVTGVRVWPQAIPQFLVGHLDTLGTAKTALSDNGLDGLFLGGNYVSGVALGRCVEGAYEIASEVTGFLSQYAYK

SEQ ID NO: 596 - skipped

SEQ ID NO: 597 - protein, 535 aa, Zea mays
MVAATATAMATAASPLLNGTRIPARLRHRGLSVRCAAVAGGAAEAPASTGARLSADCVVVGGGISGLCTAQALATRHGVGDVLVTEARARPGGNITTVERPEEGYLWEEGPNSFQPSDPVLTMAVDSGLKDDLVFGDPNAPRFVLWEGKLRPVPSKPADLPFFDLMSIPGKLRAGLGALGIRPPPPGREESVEEFVRRNLGAEVFERLIEPFCSGVYAGDPSKLSMKAAFGKVWRLEETGGSIIGGTIKTIQERSKNPKPPRDARLPKPKGQTVASFRKGLAMLPNAITSSLGSKVKLSWKLTSITKSDDKGYVLEYETPEGVVSVQAKSVIMTIPSYVASNILRPLSSDAADALSRFYYPPVAAVTVSYPKEAIRKECLIDGELQGFGQLHPRSQGVETLGTIYSSSLFPNRAPDGRVLLLNYIGGATNTGIVSKTESELVEAVDRDLRKMLINSTAVDPLVLGVRVWPQAIPQFLVGHLDLLEAAKAALDRGGYDGLFLGGNYVAGVALGRCVEGAYESASQISDFLTKYAYK

SEQ ID NO: 598 - skipped

SEQ ID NO: 599 - protein, 544 aa, Zea mays; identical to SEQ ID NO: 31

SEQ ID NO: 600 - skipped

SEQ ID NO: 601 - protein, 563 aa, Chlamydomonas
MMLTQTPGTATASSRRSQIRSAAHVSAKVAPRPTPFSVASPATAASPATAAARRTLHRTAAAATGAPTASGAGVAKTLDNVYDVIVVGGGLSGLVTGQALAAQHKIQNFLVTEARERVGGNITSMSGDGYVWEEGPNSFQPNDSMLQIAVDSGCEKDLVFGDPTAPRFVWWEGKLRPVPSGLDAFTFDLMSIPGKIRAGLGAIGLINGAMPSFEESVEQFIRRNLGDEVFFRLIEPFCSGVYAGDPSKLSMKAAFNRIWILEKNGGSLVGGAIKLFQERQSNPAPPRDPRLPPKPKGQTVGSFRKGLKMLPDAIERNIPDKIRVNWKLVSLGREADGRYGLVYDTPEGRVKVFARAVALTAPSYVVADLVKEQAPAAAEALGSFDYPPVGAVTLSYPLSAVREERKASDGSVPGFGQLHPRTQGITTLGTIYSSSLFPGRAPEGHMLLLNYIGGTTNRGIVNQTTEQLVEQVDKDLRNMVIKPDAPKPRVVGVRVWPRAIPQFNLGHLEQLDKARKALDAAGLQGVHLGGNYVSGVALGKVVEHGYESAANLAKSVSKAAVKA

SEQ ID NO: 602 - skipped

SEQ ID NO: 603 - protein, 577 aa, Polytomella
MSSSALRLLCGRTSFFNLCQKYPPSFLSQLSTLNFSTHSPFDSTYDVVVVGAGISGLSTAQALSIQHKIDNVLVTEADHRVGGKITTKRNKDFLWEEGPNSCLMNDALYRAARDAGVESKILSADPKLPRWILWGRRLRVAPIGSYALKSDLLSTQGLLRAIRGVTGFGVSPAPPKGQEESVEGFVRRTLGDEIFERLVEPFCSGVYAGDPSKLSMRAAFGKLVEFEETGDGSLLRGVFRYVMNKRRERRTGGAKDGDTVPLNETAKAPKSSSGPTVSSFEGGIEILPKAIAQKLGDRVRLGLRLVRIDPTQLADGTTAYRLSYRRMSHQGDDDSSRTAGAVPRTAEGDVAAGDEDAVVEVVAKKVVLTTPAFDAADILSRSGLVAAANPLKEVDYPPVALVVLSYDVDSISAIHRVSHVAHGLSGFGQLHPRPEGLRTLGTIYGSTLFPNRSPVARTTLLNFVGGSTDRAVGSADPMALAMEVDLDLKKSGLIREGAAKPEVLGVKVYPKAIPQFDIGHLDRVEKAKMMLKNERGGADWSGVKLAGNYVCGVAVGRCIEFGFEIAENLAQELARKK

SEQ ID NO: 604 - skipped

SEQ ID NO: 605 - protein, 544 aa, Sorghum <genus>; identical to SEQ ID NO: 28

SEQ ID NO: 606 - skipped

SEQ ID NO: 607 - protein, 536 aa, Oryza sativa
MAAAAAAMATATSATAAPPLRIRDAARRTRRRGHVRCAVASGAAEAPAAPGARVSADCVVVGGGISGLCTAQALATKHGVGDVLVTEARARPGGNITTAERAGEGYLWEEGPNSFQPSDPVLTMAVDSGLKDDLVFGDPNAPRFVLWEGKLRPVPSKPGDLPFFDLMSIPGKLRAGLGALGVRAPPPGREESVEDFVRRNLGAEVFERLIEPFCSGVYAGDPSKLSMKAAFGKVWRLEDTGGSIIGGTIKTIQERGKNPKPPRDPRLPTPKGQTVASFRKGLTMLPDAITSRLGSKVKLSWKLTSITKSDNKGYALVYETPEGVVSVQAKTVVMTIPSYVASDILRPLSSDAADALSIFYYPPVAAVTVSYPKEAIRKECLIDGELQGFGQLHPRSQGVETLGTIYSSSLFPNRAPAGRVLLLNYIGGSTNTGIVSKTESELVEAVDRDLRKMLINPKAVDPLVLGVRVWPQAIPQFLIGHLDHLEAAKSALGKGGYDGLFLGGNYVAGVALGRCVEGAYESASQISDYLTKYAYK

SEQ ID NO: 608 - skipped

SEQ ID NO: 609 - protein, 505 aa, Amaranthus; identical to SEQ ID NO: 6

SEQ ID NO: 610 - skipped

SEQ ID NO: 611 - protein, 506 aa, Arabidopsis
MELSLLRPTTQSLLPSFSKPNLRLNVYKPLRLRCSVAGGPTVGSSKIEGGGGTTITTDCVIVGGGISGLCIAQALATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSWKLSGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNYIGGSTNTGILSKSEGELVEAFLVGHFDILDTAKSSLTSSGYEGLFLGGNYVAGVALGRCVEGAYETAIEVNNFMSRYAYK

SEQ ID NO: 612 - skipped

SEQ ID NO: 613 - protein, 504 aa, Nicotiana; identical to SEQ ID NO: 20

SEQ ID NO: 614 - skipped

SEQ ID NO: 615 - protein, 502 aa, Glycine; identical to SEQ ID NO: 11

SEQ ID NO: 616 - skipped

SEQ ID NO: 617 - protein, 401 aa, Cucumis
SFQPSDPILTMVVDSGLKDDLVLGDPDAPRFVLWNGKLRPVPAKPNDLPFFDLMSIGGKIRAGFGALGIRPPPPGREESVEEFVRRNLGNEVFERLIEPFCSGVYAGDPSKLSMKAAFGKVWRLEQNGGSIIGGTFKALQERNKTTKPPRDPRLPKPKGQTVGSFRKGLTMLPNAISTCLGSKVKVSWKLSSISKVDDGGYSLTYETPEGLVSILSRSVIMTVPSYIAGTLLRPISGKAADALSKFYYPPVASVTISYPKGAIRKECLIDGELKGFGQLHPRSQGVTTLGTIYSSSLFPNRAPDGRVLLLNYIGGATNTGILSQTESELIEVVDRDLRKILINPNAEDPLPLSVRVWPQAIPQFLIGHLDVLDTAKAGLREAGMEGLFLGGNYVCGVALGR

SEQ ID NO: 618 - skipped

SEQ ID NO: 619 - protein, 506 aa, Oryza sativa; identical to SEQ ID NO: 37

SEQ ID NO: 620 - skipped

SEQ ID NO: 621 - protein, 574 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGHPASCIELNIQINLATLLYFFSGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 622 - skipped

SEQ ID NO: 623 - protein, 550 aa, Amaranthus tuberculatus
MSAMALSSSILQCPPHSDISFRFFAHTRTQPPIFFGRPRKLSYIHCSTSSSSTANYQNTITSQGEGDKVLDCVIVGAGISGLCIAQALSTKHIQSNLNFIVTEAKHRVGGNITTMESDGYIWEEGPNSFQPSDPVLTMAVDSGLKDDLVLGDPNAPRFVLWNGKLRPVPSKPTDLPFFDLMSFPGKIRAGLGALGLRPPPPSYEESVEEFVRRNLGDEVFERLIEPFCSGVYAGDPAKLSMKAAFGKVWTLEQKGGSIIAGTLKTIQERKNNPPPPRDPRLPKPKGQTVGSFRKGLIMLPTAIAARLGSKVKLSWTLSNIDKSLNGEYNLTYQTPDGPVSVRTKAVVMTVPSYIASSLLRPLSDVAADSLSKFYYPPVAAVSLSYPKEAIRPECLIDGELKGFGQLHPRSQGVETLGTIYSSSLFPGRAPPGRTLILSYIGGATNLGILQKSEDELAETVDKDLRKILINPNAKGSRVLGVRVWPKAIPQFLVGHFDVLDAAKAGLANAGQKGLFLGGNYVSGVALGRCIEGAYDSASEVVDFLSQYKDK

SEQ ID NO: 624 - skipped

SEQ ID NO: 625 - protein, 547 aa, Alopecurus myosuroides
MLTSATTPSSSSASSRASTRFASSSRPRRTAYARGRRLRPVLAMAASDDPRARSVAVVGAGISGLVAAYRLSKSGVRVTVFEADDRAGGKIRTNSDSGFLWDEGANTMTESALEASRLIDDLGLEDRLQYPNSQHKRYTVKDGAPALIPSDPIALMKSSLLSTKSKFKLFLEPFLYDKSSTKSSKKVSDEHISESVGSFFERHFGKEVVDYLIDPFVAGTSAGDPESLSIRHAFPGLWNLEKKYGSIIVGAIMSKLTAKGDKKGSAVSGKGRNKRASFSFHGGMQTLVDALHKEVGDGNVKLGAQVLSLACICDGLSASDGWSISVDSKDASNKELTKNHSFDAVIMTAPLSNVQRMKFTKGGAPFVLDFLPKVDYLPLSLMVTAFKKEDVKRPLEGFGVLIPYKEQQKHGLKTLGTLFSSMMFPDRAPNDQHLFTTFVGGSHNRDLAGAPTSILKQLVTSDLGKLLGVEGQPTFVKHIHWRNAFPLYGHDYDSALEAIGKMESDLPGFFYAGNNKDGLAVGNVIASGSKTADLVISYLESGIKQDN

SEQ ID NO: 626 - skipped

SEQ ID NO: 627 - protein, 531 aa, Alopecurus myosuroides
MVGATMAIATVTAALPLRVRVPGRSRRGQARCAVASDATEAPAAPSARLSADCVIVGGGISGLCTAQALATKYGVSDLLVTEARARPGGNITTVERPDEGYLWEEGPNSFQPSDPVLTMAVDSGLKDELVFGDPNAPRFVLWEGKLRPVPSKPGDLPFFDLMSIPGKLRAGLGALGIRPPPPGREESVEEFVRRNLGAEVFERLIEPFCSGVYAGDPSKLSMRAAFGKVWRLEENGGSIIGGTIKAIQDKGKNPKPPRDPRLPAPKGQTVASFRKGLAMLPNAIASRLGSKVKLSWKLTSITKSENQGYVLGYETPEGVVSVQAKSVIMTIPSYIASDILRPLSSDAADGLSKFYYPPVAAVTVSYPKEAIRKECLIDGELQGFGQLHPRSQGVETLGTIYSSSLFPNRAPAGRVLLLNYIGGATNTGIVSKTESDLVEAVDRDLRKMLINPRAADPLALGVRVWPQAIPQFLIGHLDRLDAAKSALVRSGCSGLFLGGNYVAGVALGRCIEGAYDSASEVSDFLNKYAYK

SEQ ID NO: 628 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSIIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 629 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSLIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 630 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSVIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 631 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGRDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 632 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLATLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 633 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTFGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 634 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTFFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 635 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKGYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 636 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKLYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 637 - protein, 551 aa, Oryza sativa
MLSPATTFSSSSSSSSPSRAHARAPTRFAVAASARAARFRPARAMAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 638 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctttgattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 639 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctttaattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 640 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctctcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 641 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctgtcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 642 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctatcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 643 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccttcttctcctcgatgatgtttccagatcgagctcctaatgatcaatatctatatacatctttcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 644 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgcgaccctcttctcctcgatgatgtttccagatcgagctcctaatgatcaatatctatatacatctttcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 645 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacctttgggaccctcttctcctcgatgatgtttccagatcgagctcctaatgatcaatatctatatacatctttcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 646 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaagagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctttcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 647 - DNA, 1656 bp, Oryza sativa; identical to SEQ ID NO: 646

SEQ ID NO: 648 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagctttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctttcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 649 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagggttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctttcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

SEQ ID NO: 650 - DNA, 1656 bp, Oryza sativa
atgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatgacagagagtgaattggaggcaagcaggcttattgacgatcttggcctacaaggcaaacagcagtatcctaactcacaacacaagcgttacattgtcaaagatggagcaccaacactgattccctcagatcccattgcgctcatgaaaagcactgttctttctacaaaatcaaagctcaagctatttctggaaccatttctctatgagaaatctagcagaaggacctcgggaaaagtgtctgatgaacatttaagtgagagtgttgcaagtttctttgaacgccactttggaaaagaggttgttgattatcttattgatccatttgtggctggaacaagcggaggagatcctgagtcattatcaattcgtcatgcatttccagcattatggaatttggagaataagtatggctctgtcattgctggtgccatcttgtccaaactatccactaagggtgattcagtgaagacaggaggtgcttcgccagggaaaggaaggaataaacgtgtgtcattttcatttcatggtggaatgcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgctccattgtctaatgtccagaggatgaagtttacaaaaggtggagttccctttgtgctagactttcttcctaaggtcgattatctaccactatctctcatggtaacagcttttaagaaggaagatgtcaaaaaaccattggaaggatttggtgccttgataccctataaggaacagcaaaagcatggtctcaaaacccttgggaccctcttctcctcgatgatgtttccagatcgagctcctaatgatcaatatctatatacatctttcattggggggagccataatagagacctcgctggggctccaacggctattctgaaacaacttgtgacctctgacctaagaaagctcttgggtgttgagggacaacctacttttgtgaagcatgtacattggagaaatgcttttcctttatatggccagaattatgatctggtactggaagctatagcaaaaatggagaacaatcttccagggttcttttacgcaggaaataacaaggatgggttggctgttggaaatgttatagcttcaggaagcaaggctgctgaccttgtgatctcttatcttgaatcttgcacagatcaggacaattag

The invention claimed is:

1. A method for controlling undesired vegetation at a plant cultivation site, the method comprising the steps of:
   a) providing, at said site, a plant that comprises at least one nucleic acid comprising a nucleotide sequence encoding a protoporphyrinogen oxidase (PPO) polypeptide which is resistant or tolerant to a PPO inhibiting herbicide;
   b) applying to said site an effective amount of said herbicide, wherein the PPO inhibiting herbicide is a uracilpyridine of formula (I)

(I)

wherein the substituents have the following meanings:
$R^1$ hydrogen, $NH_2$, $C_1$-$C_6$-alkyl or $C_3$-$C_6$-alkynyl;
$R^2$ hydrogen, $C_1$-$C_6$-alkyl or $C_1$-$C_6$-haloalkyl;
$R^3$ hydrogen or $C_1$-$C_6$-alkyl;
$R^4$ H or halogen;
$R^5$ halogen, CN, $NO_2$, $NH_2$, $CF_3$ or C(=S)$NH_2$;
$R^6$ H, halogen, CN, $C_1$-$C_3$-alkyl, $C_1$-$C_3$-haloalkyl, $C_1$-$C_3$-alkoxy, $C_1$-$C_3$-haloalkoxy, $C_1$-$C_3$-alkylthio, ($C_1$-$C_3$-alkyl)amino, di($C_1$-$C_3$-alkyl)amino, $C_1$-$C_3$-alkoxy-$C_1$-$C_3$-alkyl, $C_1$-$C_3$-alkoxycarbonyl;
$R^7$ H, halogen, $C_1$-$C_3$-alkyl, $C_1$-$C_3$-alkoxy;
$R^8$ $OR^9$, $SR^9$, $NR^{10}R^{11}$, $NR^9OR^9$, $NR^9S(O)_2R^{19}$ or $NR^9S(O)_2NR^{10}R^{11}$, wherein
$R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy) $C_1$-$C_6$-alkyl, $C_1$-$C_6$-halo-alkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, C3-C6-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)aminocarbonyl-$C_1$-$C_6$-alkyl, di($C_1$-$C_6$-alkyl)aminocarbonyl-$C_1$-$C_6$-alkyl,
—N=$CR^{12}R^{13}$, wherein $R^{12}$ and $R^{13}$ independently of one another are H, $C_1$-$C_4$-alkyl or phenyl;
$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6 membered heteroaryl,
wherein each cycloalkyl, heterocyclyl, phenyl or heteroaryl ring can be substituted by one to four substituents selected from $R^{14}$ or a 3- to 7-membered carbocyclus,
which carbocyclus optionally has in addition to carbon atoms one or two ring members selected from the group consisting of
—N($R^{12}$)—, —N=N—, —C(=O)—, —O— and —S—, and
which carbocyclus is optionally substituted with one to four substituents selected from $R^{14}$;
wherein $R^{14}$ is halogen, $NO_2$, CN, $C_1$-$C_4$-alkyl, $C_1$-$C_4$-halo-alkyl, $C_1$-$C_4$-alkoxy or $C_1$-$C_4$-alkoxycarbonyl;
$R^{10}$, $R^{11}$ independently of one another are $R^9$, or together form a 3- to 7-membered carbocyclus,
which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;
n 1 to 3;
Q $CH_2$, O, S, SO, $SO_2$, NH or ($C_1$-$C_3$-alkyl)N;
W O or S;
X NH, $NCH_3$, O or S;
Y O or S;
Z phenyl, pyridyl, pyridazinyl, pyrimidinyl or pyrazinyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy, $C_1$-$C_6$-haloalkoxy;
including their agriculturally acceptable salts or derivatives, provided the compounds of formula (I) have a carboxyl group,
and wherein the effective amount of said herbicide does not kill or inhibit the growth of the herbicide-tolerant plant of a);
wherein the herbicide resistant or tolerant PPO polypeptide comprises one or more of the following motifs 1, 2, and/or 3:
   a. Motif 1: SQ[N/K/H]KRYI, wherein the Arg at position 5 within said motif is substituted by any other amino acid;
   b. Motif 2: TLGTLFSS, wherein the Leu at position 2, and/or the Gly at position 3, and/or the Leu at position 5 within said motif is substituted by any other amino acid;
   c. Motif 3: [F/Y]TTF[V/I]GG, wherein the Phe at position 4 within said motif is substituted by any other amino acid.

2. A method for controlling undesired vegetation at a plant cultivation site, the method comprising the steps of:
   a) providing, at said site, a plant that comprises at least one nucleic acid comprising a nucleotide sequence encoding a protoporphyrinogen oxidase (PPO) polypeptide which is resistant or tolerant to a PPO inhibiting herbicide;
   b) applying to said site an effective amount of said herbicide, wherein the PPO inhibiting herbicide is a uracilpyridine of formula (I)

(I)

wherein the substituents have the following meanings:
R¹ hydrogen, NH₂, C₁-C₆-alkyl or C₃-C₆-alkynyl;
R² hydrogen, C₁-C₆-alkyl or C₁-C₆-haloalkyl;
R³ hydrogen or C₁-C₆-alkyl;
R⁴ H or halogen;
R⁵ halogen, CN, NO₂, NH₂, CF₃ or C(=S)NH₂;
R⁶ H, halogen, CN, C₁-C₃-alkyl, C₁-C₃-haloalkyl, C₁-C₃-alkoxy, C₁-C₃-haloalkoxy, C₁-C₃-alkylthio, (C₁-C₃-alkyl)amino, di(C₁-C₃-alkyl)amino, C₁-C₃-alkoxy-C₁-C₃-alkyl, C₁-C₃-alkoxycarbonyl;
R⁷ H, halogen, C₁-C₃-alkyl, C₁-C₃-alkoxy;
R⁸ OR⁹, SR⁹, NR¹⁰R¹¹, NR⁹OR⁹, NR⁹S(O)₂R¹⁰ or NR⁹S(O)₂NR¹⁰R¹¹, wherein
R⁹ is hydrogen, C₁-C₆-alkyl, C₃-C₆-alkenyl, C₃-C₆-alkynyl, C₁-C₆-haloalkyl, C₃-C₆-haloalkenyl, C₃-C₆-haloalkynyl, C₁-C₆-cyanoalkyl, C₁-C₆-alkoxy-C₁-C₆-alkyl, C₁-C₆-alkoxy-C₁-C₆-alkoxy-C₁-C₆-alkyl, di(C₁-C₆-alkoxy) C₁-C₆-alkyl, C₁-C₆-halo-alkoxy-C₁-C₆-alkyl, C₃-C₆-alkenyloxy-C₁-C₆-alkyl, C₃-C₆-haloalkenyloxy-C₁-C₆-alkyl, C₃-C₆-alkenyloxy-C₁-C₆-alkoxy-C₁-C₆-alkyl, C₁-C₆-alkylthio-C₁-C₆-alkyl, C₁-C₆-alkylsulfinyl-C₁-C₆-alkyl, C₁-C₆-alkylsulfonyl-C₁-C₆-alkyl, C₁-C₆-alkylcarbonyl-C₁-C₆-alkyl, C₁-C₆-alkoxycarbonyl-C₁-C₆-alkyl, C₁-C₆-haloalkoxycarbonyl-C₁-C₆-alkyl, C₃-C₆-alkenyloxycarbonyl-C₁-C₆-alkyl, C₃-C₆-alkynyloxycarbonyl-C₁-C₆-alkyl, amino, (C₁-C₆-alkyl)amino, di(C₁-C₆-alkyl)amino, (C₁-C₆-alkylcarbonyl)amino, amino-C₁-C₆-alkyl, (C₁-C₆-alkyl)amino-C₁-C₆-alkyl, di(C₁-C₆-alkyl)amino-C₁-C₆-alkyl, aminocarbonyl-C₁-C₆-alkyl, (C₁-C₆-alkyl)aminocarbonyl-C₁-C₆-alkyl, di(C₁-C₆-alkyl)aminocarbonyl-C₁-C₆-alkyl,
—N=CR¹²R¹³, wherein R¹² and R¹³ independently of one another are H, C₁-C₄-alkyl or phenyl;
C₃-C₆-cycloalkyl, C₃-C₆-cycloalkyl-C₁-C₆-alkyl, C₃-C₆-heterocyclyl, C₃-C₆-heterocyclyl-C₁-C₆-alkyl, phenyl, phenyl-C₁-C₄-alkyl or a 5- or 6 membered heteroaryl,
wherein each cycloalkyl, heterocyclyl, phenyl or heteroaryl ring can be substituted by one to four substituents selected from R¹⁴ or a 3- to 7-membered carbocyclus,
which carbocyclus optionally has in addition to carbon atoms one or two ring members selected from the group consisting of
—N(R¹²)—, —N=N—, —C(=O)—, —O— and —S—, and
which carbocyclus is optionally substituted with one to four substituents selected from R¹⁴;
wherein R¹⁴ is halogen, NO₂, CN, C₁-C₄-alkyl, C₁-C₄-halo¬alkyl, C₁-C₄-alkoxy or C₁-C₄-alkoxycarbonyl;
R¹⁰, R¹¹ independently of one another are R⁹, or together form a 3- to 7-membered carbocyclus,
which carbocyclus optionally has in addition to carbon atoms one or two ring members selected from the group consisting of —N(R¹²)—, —N=N—, —C(=O)—, —O— and —S—, and which carbocyclus is optionally substituted with one to four substituents selected from R¹⁴;
n 1 to 3;
Q CH₂, O, S, SO, SO₂, NH or (C₁-C₃-alkyl)N;
W O or S;
X NH, NCH₃, O or S;
Y O or S;

Z phenyl, pyridyl, pyridazinyl, pyrimidinyl or pyrazinyl, each of which is optionally substituted by 1 to 4 substituents selected from the group consisting of halogen, CN, C₁-C₆-alkyl, C₁-C₆-haloalkyl, C₁-C₆-alkoxy, C₁-C₆-haloalkoxy;
including their agriculturally acceptable salts or derivatives, provided the compounds of formula (I) have a carboxyl group, and wherein the effective amount of said herbicide does not kill or inhibit the growth of the herbicide-tolerant plant of a);
wherein the herbicide resistant or tolerant PPO polypeptide comprises a variant of the amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 577, 579, 581, 583, 585, 587, 589, 591, 593, 595, 597, 599, 601, 603, 605, 607, 609, 611, 613, 615, 617, 619, 621, 623, 625, 627, or 637, which variant comprises one or more of the following substitutions:
a. the amino acid corresponding to Arg128 of SEQ ID NO: 1 is substituted by any other amino acid;
b. The amino acid corresponding to Gly211 of SEQ ID NO: 1 is substituted by any other amino acid
c. the amino acid corresponding to Leu397 of SEQ ID NO: 1 is substituted by any other amino acid;
d. the amino acid corresponding to Gly398 of SEQ ID NO: 1 is substituted by any other amino acid
e. the amino acid corresponding to Leu400 of SEQ ID NO: 1 is substituted by any other amino acid
f. the amino acid corresponding to Phe420 of SEQ ID NO: 1 is substituted by any other amino acid.
3. A method for controlling undesired vegetation at a plant cultivation site, the method comprising the steps of:
a) providing, at said site, a plant that comprises at least one nucleic acid comprising a nucleotide sequence encoding a protoporphyrinogen oxidase (PPO) polypeptide which is resistant or tolerant to a PPO inhibiting herbicide;
b) applying to said site an effective amount of said herbicide, wherein the PPO inhibiting herbicide is a uracilpyridine of formula (I)

(I)

wherein the substituents have the following meanings:
R¹ hydrogen, NH₂, C₁-C₆-alkyl or C₃-C₆-alkynyl;
R² hydrogen, C₁-C₆-alkyl or C₁-C₆-haloalkyl;
R³ hydrogen or C₁-C₆-alkyl;
R⁴ H or halogen;
R⁵ halogen, CN, NO₂, NH₂, CF₃ or C(=S)NH₂;

$R^6$ H, halogen, CN, $C_1$-$C_3$-alkyl, $C_1$-$C_3$-haloalkyl, $C_1$-$C_3$-alkoxy, $C_1$-$C_3$-haloalkoxy, $C_1$-$C_3$-alkylthio, ($C_1$-$C_3$-alkyl)amino, di($C_1$-$C_3$-alkyl)amino, $C_1$-$C_3$-alkoxy-$C_1$-$C_3$-alkyl, $C_1$-$C_3$-alkoxycarbonyl;

$R^7$ H, halogen, $C_1$-$C_3$-alkyl, $C_1$-$C_3$-alkoxy;

$R^8$ $OR^9$, $SR^9$, $NR^{10}R^{11}$, $NR^9OR^9$, $NR^9S(O)_2R^{10}$ or $NR^9S(O)_2NR^{10}R^{11}$, wherein $R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy) $C_1$-$C_6$-alkyl, $C_1$-$C_6$-halo-alkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)aminocarbonyl-$C_1$-$C_6$-alkyl, di($C_1$-$C_6$-alkyl)aminocarbonyl-$C_1$-$C_6$-alkyl, —N=$CR^{12}R^{13}$, wherein $R^{12}$ and $R^{13}$ independently of one another are H, $C_1$-$C_4$-alkyl or phenyl;

$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6-membered heteroaryl, wherein each cycloalkyl, heterocyclyl, phenyl or heteroaryl ring can be substituted by one to four substituents selected from $R^{14}$ or a 3- to 7-membered carbocyclus, which carbocyclus optionally has in addition to carbon atoms one or two ring members selected from the group consisting of
—N($R^{12}$)—, —N=N—, —C(=O)—, —O— and —S—, and which carbocyclus is optionally substituted with one to four substituents selected from $R^{14}$;

wherein $R^{14}$ is halogen, $NO_2$, CN, $C_1$-$C_4$-alkyl, $C_1$-$C_4$-halo-alkyl, $C_1$-$C_4$-alkoxy or $C_1$-$C_4$-alkoxycarbonyl;

$R^{10}$, $R^{11}$ independently of one another are $R^9$, or together form a 3- to 7-membered carbocyclus, which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;

n 1 to 3;

Q $CH_2$, O, S, SO, $SO_2$, NH or ($C_1$-$C_3$-alkyl)N;

W O or S;

X NH, $NCH_3$, O or S;

Y O or S;

Z phenyl, pyridyl, pyridazinyl, pyrimidinyl or pyrazinyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy, $C_1$-$C_6$-haloalkoxy;

including their agriculturally acceptable salts or derivatives, provided the compounds of formula (I) have a carboxyl group, and wherein the effective amount of said herbicide does not kill or inhibit the growth of the herbicide-tolerant plant of a);

wherein the herbicide resistant or tolerant PPO polypeptide comprises the amino acid sequence of SEQ ID NO: 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, or a variant thereof.

4. A method for controlling undesired vegetation at a plant cultivation site, the method comprising the steps of:

a) providing, at said site, a plant that comprises at least one nucleic acid comprising a nucleotide sequence encoding a protoporphyrinogen oxidase (PPO) polypeptide which is resistant or tolerant to a PPO inhibiting herbicide;

b) applying to said site an effective amount of said herbicide, wherein the PPO inhibiting herbicide is a uracilpyridine of formula (I)

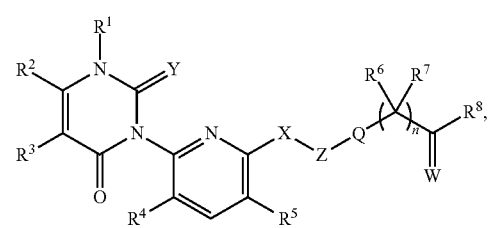

wherein the substituents have the following meanings:

$R^1$ hydrogen, $NH_2$, $C_1$-$C_6$-alkyl or $C_3$-$C_6$-alkynyl;

$R^2$ hydrogen, $C_1$-$C_6$-alkyl or $C_1$-$C_6$-haloalkyl;

$R^3$ hydrogen or $C_1$-$C_6$-alkyl;

$R^4$ H or halogen;

$R^5$ halogen, CN, $NO_2$, $NH_2$, $CF_3$ or C(=S)$NH_2$;

$R^6$ H, halogen, CN, $C_1$-$C_3$-alkyl, $C_1$-$C_3$-haloalkyl, $C_1$-$C_3$-alkoxy, $C_1$-$C_3$-haloalkoxy, $C_1$-$C_3$-alkylthio, ($C_1$-$C_3$-alkyl)amino, di($C_1$-$C_3$-alkyl)amino, $C_1$-$C_3$-alkoxy-$C_1$-$C_3$-alkyl, $C_1$-$C_3$-alkoxycarbonyl;

$R^7$ H, halogen, $C_1$-$C_3$-alkyl, $C_1$-$C_3$-alkoxy;

$R^8$ $OR^9$, $SR^9$, $NR^{10}R^{11}$, $NR^9OR^9$, $NR^9S(O)_2R^{10}$ or $NR^9S(O)_2NR^{10}R^{11}$, wherein $R^9$ is hydrogen, $C_1$-$C_6$-alkyl, $C_3$-$C_6$-alkenyl, $C_3$-$C_6$-alkynyl, $C_1$-$C_6$-haloalkyl, $C_3$-$C_6$-haloalkenyl, $C_3$-$C_6$-haloalkynyl, $C_1$-$C_6$-cyanoalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, di($C_1$-$C_6$-alkoxy) $C_1$-$C_6$-alkyl, $C_1$-$C_6$-halo-alkoxy-$C_1$-$C_6$-alkyl, $C_3$-$C_6$-alkenyloxy-$C_1$-$C_6$-alkyl, $C_3$-$C_6$-haloalkenyloxy-$C_1$-$C_6$-alkyl, $C_3$-$C_6$-alkenyloxy-$C_1$-$C_6$-alkoxy-$C_1$-$C_6$-alkyl, $C_1$-$C_6$-alkylthio-$C_1$-$C_6$-alkyl, $C_1$-$C_6$-alkylsulfinyl-$C_1$-$C_6$-alkyl, $C_1$-$C_6$-alkylsulfonyl-$C_1$-$C_6$-alkyl, $C_1$-$C_6$-alkylcarbonyl-$C_1$-$C_6$-alkyl, $C_1$-$C_6$-alkoxycarbonyl-$C_1$-$C_6$-alkyl, $C_1$-$C_6$-haloalkoxycarbonyl-$C_1$-$C_6$-alkyl, $C_3$-$C_6$-alkenyloxycarbonyl-$C_1$-$C_6$-alkyl, $C_3$-$C_6$-alkynyloxycarbonyl-$C_1$-$C_6$-alkyl, amino, ($C_1$-$C_6$-alkyl)amino, di($C_1$-$C_6$-alkyl)amino, ($C_1$-$C_6$-alkylcarbonyl)amino, amino-$C_1$-$C_6$-alkyl, ($C_1$-$C_6$-alkyl)amino-$C_1$-$C_6$-alkyl, di($C_1$-$C_6$-alkyl)amino-$C_1$-$C_6$-alkyl, aminocarbonyl-$C_1$-$C_6$-alkyl, ($C_1$-$C_6$-alkyl)aminocarbonyl-$C_1$-$C_6$-alkyl, di($C_1$-$C_6$-alkyl)aminocarbonyl-$C_1$-$C_6$-alkyl, —N=$CR^{12}R^{13}$, wherein $R^{12}$ and $R^{13}$ independently of one another are H, $C_1$-$C_4$-alkyl or phenyl;

$C_3$-$C_6$-cycloalkyl, $C_3$-$C_6$-cycloalkyl-$C_1$-$C_6$-alkyl, $C_3$-$C_6$-heterocyclyl, $C_3$-$C_6$-heterocyclyl-$C_1$-$C_6$-alkyl, phenyl, phenyl-$C_1$-$C_4$-alkyl or a 5- or 6-membered heteroaryl, wherein each cycloalkyl, heterocyclyl, phenyl or heteroaryl ring can be substituted by one to four substituents selected from $R^{14}$ or a 3- to 7-membered carbocyclus, which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;

wherein $R^{14}$ is halogen, $NO_2$, CN, $C_1$-$C_4$-alkyl, $C_1$-$C_4$-halo-alkyl, $C_1$-$C_4$-alkoxy or $C_1$-$C_4$-alkoxycarbonyl;

$R^{10}$, $R^{11}$ independently of one another are $R^9$, or together form a 3- to 7-membered carbocyclus, which carbocyclus optionally has in addition to carbon atoms one or two ring members selected from the group consisting of —N($R^{12}$)—, —N=N—, —C(=O)—, —O— and —S—, and which carbocyclus is optionally substituted with one to four substituents selected from $R^{14}$;

n 1 to 3;

Q $CH_2$, O, S, SO, $SO_2$, NH or ($C_1$-$C_3$-alkyl)N;

W O or S;

X NH, $NCH_3$, O or S;

Y O or S;

Z phenyl, pyridyl, pyridazinyl, pyrimidinyl or pyrazinyl, each of which is optionally substituted by 1 to 4 substituents selected from the group consisting of halogen, CN, $C_1$-$C_6$-alkyl, $C_1$-$C_6$-haloalkyl, $C_1$-$C_6$-alkoxy, $C_1$-$C_6$-haloalkoxy;

including their agriculturally acceptable salts or derivatives, provided the compounds of formula (I) have a carboxyl group, and wherein the effective amount of said herbicide does not kill or inhibit the growth of the herbicide-tolerant plant of a);

wherein the herbicide resistant or tolerant PPO polypeptide comprises the amino acid sequence of SEQ ID NO: 240, 241, 242, 243, 244, 245, 246, 247, 248, 249, 250, 251, 252, 253, 254, 255, 256, 257, 258, 259, 260, 261, or 262.

5. The method according to claim 1, wherein the plant comprises at least one additional heterologous nucleic acid comprising a nucleotide sequence encoding a herbicide tolerance enzyme.

6. The method according to claim 1, wherein the uracilpyridine of formula (I) is applied in conjunction with one or more additional herbicides.

7. The method according to claim 2, wherein the plant comprises at least one additional heterologous nucleic acid comprising a nucleotide sequence encoding a herbicide tolerance enzyme.

8. The method according to claim 2, wherein the uracilpyridine of formula (I) is applied in conjunction with one or more additional herbicides.

9. The method according to claim 3, wherein the plant comprises at least one additional heterologous nucleic acid comprising a nucleotide sequence encoding a herbicide tolerance enzyme.

10. The method according to claim 3, wherein the uracilpyridine of formula (I) is applied in conjunction with one or more additional herbicides.

11. The method according to claim 4, wherein the plant comprises at least one additional heterologous nucleic acid comprising a nucleotide sequence encoding a herbicide tolerance enzyme.

12. The method according to claim 4, wherein the uracilpyridine of formula (I) is applied in conjunction with one or more additional herbicides.

\* \* \* \* \*